(12) United States Patent
Gelman et al.

US009205100B2

(10) Patent No.: US 9,205,100 B2
(45) Date of Patent: *Dec. 8, 2015

(54) COMPOSITIONS AND METHODS FOR TREATING LUNG DISEASE AND INJURY

(75) Inventors: Andrew E. Gelman, Saint Louis, MO (US); Elena Feinstein, Rehovot (IL); Svetlana Adamsky, Gedera (IL); Igor Mett, Rehovot (IL); Hagar Kalinski, Rishon-le-Zion (IL); Sharon Avkin-Nachum, Nes Zionna (IL)

(73) Assignees: Quark Pharmaceuticals, Inc., Fremont, CA (US); Washington University, Saint Louis, MO (US)

( * ) Notice: Subject to any disclaimer, the term of this patent is extended or adjusted under 35 U.S.C. 154(b) by 0 days.

This patent is subject to a terminal disclaimer.

(21) Appl. No.: 14/002,660

(22) PCT Filed: Mar. 1, 2012

(86) PCT No.: PCT/US2012/027169
§ 371 (c)(1),
(2), (4) Date: Sep. 17, 2013

(87) PCT Pub. No.: WO2012/118910
PCT Pub. Date: Sep. 7, 2012

(65) Prior Publication Data
US 2014/0005253 A1 Jan. 2, 2014

Related U.S. Application Data

(60) Provisional application No. 61/448,723, filed on Mar. 3, 2011.

(51) Int. Cl.
*C12N 15/11* (2006.01)
*A61K 31/713* (2006.01)
*C12N 15/113* (2010.01)

(52) U.S. Cl.
CPC .......... *A61K 31/713* (2013.01); *C12N 15/1138* (2013.01); *C12N 2310/14* (2013.01); *C12N 2310/321* (2013.01); *C12N 2310/344* (2013.01)

(58) Field of Classification Search
None
See application file for complete search history.

(56) References Cited

U.S. PATENT DOCUMENTS

2010/0215588 A1* 8/2010 Skaliter ........................... 424/45

FOREIGN PATENT DOCUMENTS

WO WO 2005085443 A2 * 9/2005
WO 2010118334 A1 10/2010

OTHER PUBLICATIONS

Jin et al, N-acetylcysteine inhibits activation of toll-like receptor 2 and 4 gene expressionin the liver and lung after partial hepatic ischemia-reperfusion injury in mice, 2007, Hepatobiliary & Pancreatic Diseases International, vol. 6, 3: 284-289.*
Shimamoto et al, Toll-Like Receptor 4 Mediates Lung Ischemia-Reperfusion Injury, 2006, Ann Thorac Surg., 82, 6: 2017-2023.*
Wu et al, Effect of nitric oxide on toll-like receptor 2 and 4 gene expression in rats with acute lung injury complicated by acute hemorrhage necrotizing pancreatitis, 2005, Hepatobilliary Pancreat Dis Int, vol. 4, 4: 609-613.*
Tokairin et al, Enhanced immediate inflammatory response to *Streptococcus pneumoniae* in the lungs of mice with pulmonary emphysema, 2008, Respirology, 13: 324-332.*
Arslan et al., TLR2 and TLR4 in Ischemia Reperfusion Injury. Mediators Inflamm. 2010;2010:704202 (8 pages).
Devaraj et al., Increased secretion of IP-10 from monocytes under hyperglycemia is via the TLR2 and TLR4 pathway. Cytokine. Jul. 2009;47(1):6-10.
Elson et al., Contribution of Toll-like receptors to the innate immune response to Gram-negative and Gram-positive bacteria. Blood. Feb. 15, 2007;109(4):1574-1583.
International Preliminary Report on Patentability issued in PCT/US2012/027169 dated Sep. 12, 2013.
Allshire, Molecular biology. RNAi and Heterochromatin—a Hushed-Up Affair. Science. Sep. 13, 2002;297 (5588):1818-1819.
Bass, RNA interference.The short answer. Nature. May 24, 2001;411(6836):428-429.
Bernstein et al., Role for a bidentate ribonuclease in the initiation step of RNA interference. Nature Jan. 18, 2001; 409(6818):363-366.
Bettinger et al., Size Reduction of Galactosylated PEI/DNA Complexes Improves Lectin-Mediated Gene Transfer into Hepatocytes. Bioconjug Chem. Jul.-Aug. 1999;10(4):558-561.
Brody and Gold, Aptamers as therapeutic and diagnostic agents. J Biotechnol. Mar. 2000;74(1):5-13.
Clemens and Elia, The Double-Stranded RNA-Dependent Protein Kinase PKR: Structure and Function. J Interferon Cytokine Res. Sep. 1997;17(9):503-524.
Elmen et al., Locked nucleic acid (LNA) mediated improvements in siRNA stability and functionality. Nucleic Acids Res. Jan. 14, 2005;33(1):439-447.

(Continued)

*Primary Examiner* — Tracy Vivlemore
*Assistant Examiner* — Kate Poliakova
(74) *Attorney, Agent, or Firm* — Nutter McClennen & Fish LLP; Konstantin M. Linnik; Isaac A. Hubner

(57) ABSTRACT

Disclosed herein are therapeutic methods for treating lung diseases, disorders and injury in a mammal, including treatment of acute respiratory distress syndrome (ARDS), acute lung injury, pulmonary fibrosis (idiopathic), bleomycin induced pulmonary fibrosis, mechanical ventilator induced lung injury, chronic obstructive pulmonary disease (COPD), chronic bronchitis, emphysema, bronchiolitis obliterans after lung transplantation and lung transplantation-induced acute graft dysfunction, including treatment, prevention or prevention of progression of primary graft failure, ischemia-reperfusion injury, reperfusion injury, reperfusion edema, allograft dysfunction, pulmonary reimplantation response, bronchiolitis obliterans after lung transplantation and/or primary graft dysfunction (PGD) after organ transplantation, in particular in lung transplantation, comprising downregulating the TLR2 gene or both the TLR2 gene and TLR4 gene. Provided herein are compositions, methods and kits for treating lung diseases, disorders and injury.

6 Claims, 6 Drawing Sheets

(56) References Cited

OTHER PUBLICATIONS

Ferentz and Verdine, Disulfide Cross-Linked Oligonucleotides. J Am Chem Soc. 1991;113:4000-4002.

Furgeson et al., Modified Linear Polyethylenimine-Cholesterol Conjugates for DNA Complexation. Bioconjug Chem. Jul.-Aug. 2003;14(4):840-847.

Godbey et al., Poly(ethylenimine) and its role in gene delivery. J Control Release. Aug. 5, 1999;60(2-3):149-160.

Gold et al., Diversity of Oligonucleotide Functions. Annu Rev Biochem. 1995;64:763-797.

Gonzalez et al., New Class of Polymers for the Delivery of Macromolecular Therapeutics. Bioconjug Chem. Nov.-Dec. 1999;10(6):1068-1074.

Hermann and Patel, Adaptive Recognition by Nucleic Acid Aptamers. Science. Feb. 4, 2000;287(5454):820-825.

Izant and Weintraub, Constitutive and Conditional Suppression of Exogenous and Endogenous Genes by Anti-Sense RNA. Science. Jul. 26, 1985;229(4711):345-352.

Jaschke et al., Automated Incorporation of Polyethylene Glycol into Synthetic Oligonucleotides. Tetrahedron Lett. 1993;34(2):301-304.

Jenuwein, Molecular biology. An RNA-Guided Pathway for the Epigenome. Science. Sep. 27, 2002;297 (5590):2215-2218.

Krupnick et al., Orthotopic Mouse Lung Transplantation as Experimental Methodology to Study Transplant and Tumor Biology. Nat Protoc. 2009;4(1):86-93.

Kunath et al., The Structure of PEG-Modified Poly(Ethylene Imines) Influences Biodistribution and Pharmacokinetics of Their Complexes with NF-kappaB Decoy in Mice. Pharm Res. Jun. 2002;19(6):810-817.

Kusser, Chemically modified nucleic acid aptamers for in vitro selections: evolving evolution. J Biotechnol. Mar. 2000;74(1):27-38.

Lieber et al., Stable High-Level Gene Expression in Mammalian Cells by T7 Phage RNA Polymerase. Methods Enzymol. 1993;217:47-66.

Paul et al., Effective expression of small interfering RNA in human cells. Nat Biotechnol. May 2002;20(5):505-508.

Strauss, Molecular biology. Candidate 'Gene Silencers' Found. Science. Oct. 29, 1999;286(5441):886.

The International Search Report issued in PCT/US20121027169 on Jun. 11, 2012.

The Written Opinion issued in PCT/US2012/027169 on Jun. 11, 2012.

Jiang et al., "The role of Toll-like receptors in non-infectious lung injury", Cell Research, 2006, 693-701.

* cited by examiner

COMPOSITIONS AND METHODS FOR TREATING LUNG DISEASE AND INJURY

RELATED APPLICATIONS

The present invention is filed under 35 U.S.C. §371 as the U.S. national phase of International Application No. PCT/US2012/027169, filed Mar. 1, 2012, which designated the U.S. and claims the benefit of priority to U.S. Provisional Patent Application No. 61/448,723, filed Mar. 3, 2011, entitled "Combination Therapy for Treating Lung Disease And Injury" and which is incorporated herein by reference in its entirety and for all purposes.

SEQUENCE LISTING

The instant application contains a Sequence Listing, which is entitled QUARK0005US_SeqListing.txt, created on Aug. 30, 2013 and 2280 kb in size, and is hereby incorporated by reference in its entirety.

Throughout this application various patents and publications are cited. The disclosures of these documents in their entireties are hereby incorporated by reference into this application to more fully describe the state of the art to which this invention pertains.

FIELD OF THE INVENTION

Compositions, methods and kits for treating lung disease and injury are provided herein.

SUMMARY OF THE INVENTION

Compositions, methods and kits for treating lung diseases are provided herein. In certain aspects and embodiments, provided are compositions and methods for therapy for treating lung disorders or injury in a mammal, including treatment of acute respiratory distress syndrome (ARDS), acute lung injury, pulmonary fibrosis (idiopathic), bleomycin induced pulmonary fibrosis, mechanical ventilator induced lung injury, chronic obstructive pulmonary disease (COPD), chronic bronchitis, emphysema, lung transplantation-induced acute graft dysfunction and bronchiolitis obliterans after lung transplantation. In certain aspects and embodiments, provided are compositions and methods for combination therapy for treating or preventing inflammation and/or graft rejection associated with organ transplantation, in particular lung transplantation, including treatment, prevention or attenuation of progression of primary graft failure, ischemia-reperfusion injury, reperfusion injury, reperfusion edema, allograft dysfunction, pulmonary reimplantation response, bronchiolitis obliterans after lung transplantation and/or primary graft dysfunction (PGD) after organ transplantation, in particular in lung transplantation. In certain aspects and embodiments, provided are compositions and methods for combination therapy for treating lung disorders or injury in a mammal. The compositions and methods involve inhibiting the gene Toll-like receptor 2 (TLR2) or the genes Toll-like receptor 2 (TLR2) and Toll-like receptor 4 (TLR4).

In various aspects and embodiments, compositions, methods and kits provided herein may target, decrease, down-regulate or inhibit the expression/activity/function of the gene Toll-like receptor 2 (TLR2). In various aspects and embodiments, compositions, methods and kits provided herein may target, decrease, down-regulate or inhibit the expression/activity/function of the genes: (i) Toll-like receptor 2 (TLR2) and (ii) Toll-like receptor 4 (TLR4).

In one aspect, provided is a method for treating a lung disorder, disease or injury in a mammal in need thereof. The method may include administering to the mammal at least one therapeutic agent selected from a TLR2 inhibitor or a pharmaceutically acceptable salt or prodrug thereof, in an amount effective to treat the mammal.

In another aspect, provided is a method for treating a lung disorder, disease or injury in a mammal in need thereof. The method may include administering to the mammal at least two therapeutic agents selected from: (i) a TLR2 inhibitor or a pharmaceutically acceptable salt or prodrug thereof, and (ii) a TLR4 inhibitor or a pharmaceutically acceptable salt or prodrug thereof; in an amount effective to treat the mammal.

The methods may include preventing, treating, ameliorating, and/or slowing the progression of lung disorders or injury, such as, without being limited to, ARDS, acute lung injury, pulmonary fibrosis (idiopathic), bleomycin induced pulmonary fibrosis, mechanical ventilator induced lung injury, COPD and disease, disorder or injury associated with lung transplantation in a subject. The method may involve treating, ameliorating, and/or slowing the progression of the aforementioned diseases or conditions or associated symptoms or complications thereof by administering to said subject a therapeutically effective amount of a therapeutic agent directed to the gene TLR2. The method may involve treating, ameliorating, and/or slowing the progression of the aforementioned diseases or conditions or associated symptoms or complications thereof by administering to said subject a therapeutically effective amount of at least one therapeutic agent that down regulates TLR2 and at least one therapeutic agent that down regulates TLR4. The method may involve treating, ameliorating, and/or slowing the progression of the aforementioned diseases or conditions or associated symptoms or complications thereof by administering to said subject a therapeutically effective amount of a single therapeutic agent, which is capable of down-regulating the genes TLR2 and TLR4 and/or the gene products of the genes TLR2 and TLR4.

In various embodiments the provided methods of treating a lung disease, disorder or injury comprise inhibiting the gene Toll-like receptor 2 (TLR2) in combination with one or more additional treatment methods selected from the group consisting of surgery, steroid therapy, non-steroid therapy, antibiotic therapy, antiviral therapy, antifungal therapy, immunosuppressant therapy, anti-infective therapy, anti-hypertensive therapy and nutritional supplements. In various embodiments the additional treatment is administered prior to, subsequent to or concomitantly with the provided method for treating a lung disorder, disease or injury. In various embodiments the provided methods of treating a lung disease, disorder or injury comprise inhibiting the gene Toll-like receptor 2 (TLR2) in combination with immunosuppressant therapy. In various embodiments the provided methods of treating a lung disease, disorder or injury comprise inhibiting the genes Toll-like receptor 2 (TLR2) and Toll-like receptor 4 (TLR4) in combination with one or more additional treatment methods selected from the group consisting of surgery, steroid therapy, non-steroid therapy, antibiotic therapy, antiviral therapy, antifungal therapy, antimicrobial therapy, immunosuppressant therapy, anti-infective therapy, anti-hypertensive therapy and nutritional supplements. In various embodiments the provided methods of treating a lung disease, disorder or injury comprise down-regulating the gene Toll-like receptor 2 (TLR2) and the gene Toll-like receptor 4 (TLR4) in combination with immunosuppressant therapy.

In certain embodiments the provided methods may include one or more of the following:

A. Administration of a pharmaceutical composition comprising a therapeutic agent selected from a TLR2 inhibitor or a pharmaceutically acceptable salt or prodrug thereof; and a pharmaceutically acceptable carrier; or B. Co-administration, e.g. concomitantly or in sequence, of a therapeutically effective amount of at least two therapeutic agents, wherein at least one therapeutic agent is for down-regulating the gene TLR2 and at least one therapeutic agent is for down-regulating the gene TLR4; and the therapeutic agents are selected from: (i) a TLR2 inhibitor or a pharmaceutically acceptable salt or prodrug thereof, and (ii) a TLR4 inhibitor or a pharmaceutically acceptable salt or prodrug thereof; or C. Administration of a pharmaceutical composition comprising a combination of at least two therapeutic agents, wherein at least one therapeutic agent is for down-regulating the gene TLR2 and at least one therapeutic agent is for down-regulating the gene TLR4; and the therapeutic agents are selected from: (i) a TLR2 inhibitor or a pharmaceutically acceptable salt or prodrug thereof, and (ii) a TLR4 inhibitor or a pharmaceutically acceptable salt or prodrug thereof; and a pharmaceutically acceptable carrier; or D. Administration of a pharmaceutical composition comprising a therapeutic agent which is capable of down-regulating the genes TLR2 and TLR4 and/or the gene products of the genes TLR2 and TLR4. Non-limiting examples of such single agents are tandem and multi-armed RNAi molecules disclosed in PCT Patent Publication No. WO 2007/091269.

In one aspect, provided is a medicament that includes a therapeutic agent which target, decrease, down-regulate or inhibit the expression/activity/function of the gene TLR2, or a pharmaceutically acceptable salt or prodrug thereof. Therapeutic agents useful in the combination as provided herein include, but are not limited to, small organic molecule chemical compounds; proteins, antibodies or fragments thereof, peptides, peptidomimetics and nucleic acid molecules.

In another aspect, provided is a medicament that includes at least two therapeutic agents which target, decrease, down-regulate or inhibit the expression/activity/function of the genes: (i) TLR2 and (ii) TLR4, wherein at least one therapeutic agent down-regulates the gene TLR2 and at least one therapeutic agent down-regulates the gene TLR4; and the therapeutic agents are selected from: (i) a TLR2 inhibitor or a pharmaceutically acceptable salt or prodrug thereof, and (ii) a TLR4 inhibitor or a pharmaceutically acceptable salt or prodrug thereof. Therapeutic agents useful in the combination as provided herein include, but are not limited to, small organic molecule; proteins, antibodies or fragments thereof, peptides, peptidomimetics and nucleic acid molecules.

In some embodiments the therapeutic agent comprises a nucleic acid molecule. In some embodiments each nucleic acid molecule is independently selected from the group consisting of an antisense molecule, a short interfering nucleic acid (siNA), short interfering RNA (siRNA), double-stranded RNA (dsRNA), micro-RNA (miRNA) or short hairpin RNA (shRNA) that bind a nucleotide sequence (such as an mRNA sequence) encoding a target gene selected from TLR2 and TLR4, for example:

the mRNA coding sequence for human TLR2 exemplified by SEQ ID NO:1 (gi|68160956|ref|NM_003264.3| Homo sapiens toll-like receptor 2 (TLR2), mRNA), or the mRNA coding sequence for human TLR4 exemplified by SEQ ID NO:2 (gi|207028550|ref|NR_024169.1| Homo sapiens toll-like receptor 4 (TLR4), transcript variant 4, non-coding RNA); or the mRNA coding sequence for human TLR4 exemplified by SEQ ID NO:3 (gi|207028620|ref|NM_138554.3| Homo sapiens toll-like receptor 4 (TLR4), transcript variant 1, mRNA); or the mRNA coding sequence for human TLR4 exemplified by SEQ ID NO:4 (gi|207028451|ref|NR_024168.1| Homo sapiens toll-like receptor 4 (TLR4), transcript variant 3, non-coding RNA).

In various embodiments each nucleic acid molecule is or includes a dsRNA molecule or a siRNA molecule. In various embodiments, the nucleic acid molecule (a) includes a sense strand and an antisense strand; (b) each strand of the nucleic acid molecule is independently 17 to 40 nucleotides in length; (c) a 17 to 40 nucleotide sequence of the antisense strand is complementary to a sequence of an mRNA encoding human TLR2 (e.g., SEQ ID NO: 1) or TLR4 (e.g., SEQ ID NOs: 2-4); and (d) a 17 to 40 nucleotide sequence of the sense strand is complementary to the a sequence of the antisense strand and includes a 17 to 40 nucleotide sequence of an mRNA encoding human TLR2 (e.g., SEQ ID NO: 1) or TLR4 (e.g., SEQ ID NOs: 2-4).

A pharmaceutical product as provided herein may, for example, be a pharmaceutical composition including the therapeutic agent in a pharmaceutically acceptable carrier. A pharmaceutical product as provided herein may, for example, be a pharmaceutical composition including the first and second therapeutic agent in admixture in a pharmaceutically acceptable carrier. Alternatively, the pharmaceutical product may, for example, be a kit comprising a preparation of the first therapeutic agent and a preparation of the second therapeutic agent and, optionally, instructions for the simultaneous, sequential or separate administration of the preparations to a patient in need thereof.

In a first aspect, provided is a method of preventing or reducing the symptoms of primary graft dysfunction (PGD) in a recipient of a lung transplant, comprising administering to the recipient a therapeutically-effective amount of at least one TLR2 inhibitor or a pharmaceutically acceptable salt or prodrug thereof, and a therapeutically-effective amount of at least one TLR4 inhibitor or a pharmaceutically acceptable salt or prodrug thereof, thereby preventing or reducing the symptoms of PGD in the recipient. In various embodiments the symptoms of PGD include inflammation, acute graft rejection, graft rejection, ischemia-reperfusion injury, reperfusion injury, impaired pulmonary function, bronchiolitis obliterans, impaired blood oxygenation, increased inflammatory cytokine production, intra-graft and intra-airway accumulation of granulocytes, pulmonary edema and hypoxemia.

In some embodiments, the recipient of the lung transplant is a human that is at risk of developing or is being treated for primary graft dysfunction (PGD). In some embodiments the method as provided herein may, for example, be use for preventing or reducing the symptoms of cold ischemia-associated PGD. Alternatively, the method may, for example, be for preventing or reducing the symptoms of warm ischemia-associated PGD.

In various embodiments, the administration of the at least one TLR2 inhibitor or a pharmaceutically acceptable salt or prodrug thereof, and the at least one TLR4 inhibitor or a pharmaceutically acceptable salt or prodrug thereof results in one or more of the following: reduced pulmonary edema, increased blood oxygenation, preserved blood oxygenation, improved pulmonary function, preserved pulmonary function in the recipient of a lung transplant and improved pulmonary function of the transplanted lung.

In various embodiments, the at least one TLR2 inhibitor and the at least one TLR4 inhibitor are administered to the recipient of a lung transplant prior to, during or following the lung transplantation.

In some embodiments, the at least one TLR2 inhibitor and the at least one TLR4 inhibitor are co-administered to the recipient in the same formulation. Alternatively, the at least one TLR2 inhibitor and the at least one TLR4 inhibitor are co-administered to the recipient in different formulations.

In some embodiments, the at least one TLR2 inhibitor and the at least one TLR4 inhibitor are co-administered to the recipient by the same route. In other embodiments, the at least one TLR2 inhibitor and the at least one TLR4 inhibitor are co-administered to the recipient by different routes. In various embodiments, the methods comprise simultaneous administration of the at least one TLR2 inhibitor and the at least one TLR4 inhibitor. In some embodiments, the methods comprise separate administration of the at least one TLR2 inhibitor and the at least one TLR4 inhibitor. In some embodiments, the methods comprise combined administration of the at least one TLR2 inhibitor and the at least one TLR4 inhibitor. In other embodiments, the methods comprise sequential administration of the at least one TLR2 inhibitor and the at least one TLR4 inhibitor.

In various embodiments the provided method of preventing or reducing the symptoms of primary graft dysfunction (PGD) in a recipient of a lung transplant, further comprises at least one additional treatment selected from the group consisting of surgery, steroid therapy, non-steroid therapy, antiviral therapy, antifungal therapy, antimicrobial therapy, immunosuppressant therapy, anti-infective therapy, anti-hypertensive therapy, nutritional supplements and any combination thereof. In various embodiments, the additional treatment is administered prior to, subsequent to or concomitantly with administering of at least one TLR2 inhibitor and at least one TLR4 inhibitor. In some embodiments, the additional treatment comprises immunosuppressant therapy.

In various embodiments, the route of administration of at least one TLR2 inhibitor and at least one TLR4 inhibitor is selected from: systemic administration or local administration. In various embodiments, the method of administration of at least one TLR2 inhibitor and at least one TLR4 inhibitor to the recipient of a lung transplant is selected from the group comprising: intravenous, intraarterial, intraperitoneal, intramuscular, intraportal, subcutaneous, direct injection, intratracheal instillation, inhalation, intranasal, pulmonary and administration via pump into the lung. In some embodiments, at least one TLR2 inhibitor and at least one TLR4 inhibitor are administered to the recipient of a lung transplant by inhalation. In another embodiments, at least one TLR2 inhibitor and at least one TLR4 inhibitor are administered to the recipient of a lung transplant by intratracheal instillation.

In various embodiments of the provided method of preventing or reducing the symptoms of primary graft dysfunction (PGD) in a recipient of a lung transplant, the at least one TLR2 inhibitor and the at least one TLR4 inhibitor are each independently selected from the group consisting of a small organic molecule, a protein, an antibody or fragment thereof, a peptide, a peptidomimetic and a nucleic acid molecule. In some embodiments, at least one inhibitor comprises a nucleic acid molecule. In other embodiments, each inhibitor comprises a nucleic acid molecule. In some embodiments, each inhibitor comprises a nucleic acid molecule and the first nucleic acid molecule is a double-stranded oligonucleotide that binds a nucleotide sequence encoding a TLR2 gene and the second nucleic acid molecule is a double-stranded oligonucleotide that binds a nucleotide sequence encoding a TLR4 gene. In some embodiments the double-stranded oligonucleotides are linked one to the other in tandem or annealed in RNAistar formation.

In some embodiments the first double-stranded oligonucleotide comprises:
(a) a sense strand and an antisense strand;
(b) each strand is independently 17 to 40 nucleotides in length;
(c) a 17 to 40 nucleotide sequence of the antisense strand is complementary to a sequence of an mRNA encoding TLR2; and
(d) a 17 to 40 nucleotide sequence of the sense strand is complementary to the antisense strand;
and the second double-stranded oligonucleotide comprises:
(a) a sense strand and an antisense strand;
(b) each strand is independently 17 to 40 nucleotides in length;
(c) a 17 to 40 nucleotide sequence of the antisense strand is complementary to a sequence of an mRNA encoding TLR4; and
(d) a 17 to 40 nucleotide sequence of the sense strand is complementary to the antisense strand.

In various embodiments the mRNA polynucleotide sequence of TLR2 is set forth in SEQ ID NO:1 and the mRNA polynucleotide sequence of TLR4 is set forth in any one of SEQ ID NO:2, SEQ ID NO:3 and SEQ ID NO:4.

In some embodiments, the first double-stranded oligonucleotide and the second double-stranded oligonucleotide are co-administered to the recipient in the same formulation. In other embodiments, the first double-stranded oligonucleotide and the second double-stranded oligonucleotide are co-administered to the recipient in different formulations. In some embodiments, the first double-stranded oligonucleotide and the second double-stranded oligonucleotide are co-administered to the recipient by the same route. In some embodiments, the first double-stranded oligonucleotide and the second double-stranded oligonucleotide are co-administered to the recipient by different routes. In various embodiments the mode of administration of the first double-stranded oligonucleotide and the second double-stranded oligonucleotide to the recipient of the lung transplant is selected from the group comprising: separate, combined, simultaneous and sequential administration.

In some embodiments, the first double-stranded oligonucleotide and the second double-stranded oligonucleotide are formulated for administering to the recipient once. In other embodiments, the first double-stranded oligonucleotide and the second double-stranded oligonucleotide are formulated for administering to the recipient at least once-a-day. In yet other embodiments, the first double-stranded oligonucleotide and the second double-stranded oligonucleotide are formulated for multiple administrations to the recipient.

In some embodiments of the provided method of preventing or reducing the symptoms of primary graft dysfunction (PGD) in a recipient of a lung transplant, at least one double-stranded oligonucleotide independently comprises a structure (A1):

(A1)    5' (N)x-Z 3'         (antisense strand)

3' Z'-(N')y-z" 5'    (sense strand)

wherein each of N and N' is a ribonucleotide which may be unmodified or modified, or an unconventional moiety;
wherein each of (N)x and (N')y is an oligonucleotide in which each consecutive N or N' is joined to the next N or N' by a covalent bond;

wherein each of Z and Z' is independently present or absent, but if present is independently 1-5 consecutive nucleotides or unconventional moieties or a combination thereof covalently attached at the 3' terminus of the strand in which it is present.

wherein z" may be present or absent, but if present is a capping moiety covalently attached at the 5' terminus of (N')y; wherein each of x and y is independently an integer between 17 and 40;

wherein the sequence of (N')y is complementary to the sequence of (N)x; and wherein (N)x comprises an antisense sequence to an mRNA selected from an mRNA encoding TLR2 and an mRNA encoding TLR4.

In various embodiments of structure (A1), the mRNA polynucleotide sequence of TLR2 is set forth in SEQ ID NO:1 and the mRNA polynucleotide sequence of TLR4 is set forth in any one of SEQ ID NO:2, SEQ ID NO:3 and SEQ ID NO:4.

In some preferred embodiments of structure (A1), x=y=19.

In some embodiments of structure (A1), (N)x comprises an antisense oligonucleotide selected from the group consisting of oligonucleotides having SEQ ID NOs: 723-1440, 2247-3052, 7076-8312 and 8459-8604 and (N')y comprises a complementary sense strand oligonucleotide selected from the group consisting of oligonucleotides having SEQ ID NOs: 5-722, 1441-2246, 5839-7075 and 8313-8458.

In various embodiments of the provided method of preventing or reducing the symptoms of primary graft dysfunction (PGD) in a recipient of a lung transplant, administration of the at least one double-stranded oligonucleotide that binds a nucleotide sequence encoding a TLR2 gene and the at least one double-stranded oligonucleotide that binds a nucleotide sequence encoding a TLR4 gene results in down-regulation of TLR2 expression and TLR4 expression, respectively.

In some embodiments of the provided method of preventing or reducing the symptoms of primary graft dysfunction (PGD) in a recipient of a lung transplant, at least one double-stranded compound independently comprises a structure (A2):

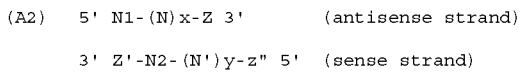

wherein each of N2, N and N' is independently an unmodified or modified ribonucleotide, or an unconventional moiety;

wherein each of (N)x and (N')y is an oligonucleotide in which each consecutive N or N' is joined to the adjacent N or N' by a covalent bond;

wherein each of x and y is independently an integer between 17 and 39;

wherein the sequence of (N')y is complementary to the sequence of (N)x and wherein (N)x is complementary to a consecutive sequence in an mRNA selected from an mRNA encoding TLR2 and an mRNA encoding TLR4;

wherein N1 is covalently bound to (N)x and is mismatched to the mRNA selected from an mRNA encoding TLR2 and an mRNA encoding TLR4;

wherein N1 is a moiety selected from the group consisting of uridine, modified uridine, ribothymidine, modified ribothymidine, deoxyribothymidine, modified deoxyribothymidine, riboadenine, deoxyriboadenine and modified deoxyriboadenine, wherein z" may be present or absent, but if present is a capping moiety covalently attached at the 5' terminus of N2-(N')y; and wherein each of Z and Z' is independently present or absent, but if present is independently 1-5 consecutive nucleotides or unconventional moieties or a combination thereof covalently attached at the 3' terminus of the strand in which it is present.

In various embodiments of structure (A2), the mRNA polynucleotide sequence of TLR2 is set forth in SEQ ID NO:1 and the mRNA polynucleotide sequence of TLR4 is set forth in any one of SEQ ID NO:2, SEQ ID NO:3 and SEQ ID NO:4.

In some preferred embodiments of structure (A2), x=y=18.

In some embodiments of structure (A2), the sequence of (N)x comprises an antisense strand oligonucleotide selected from the group consisting of oligonucleotides having SEQ ID NOs: 4153-5252, 5546-5838, 10319-12032, and 12085-12136 and the sequence of (N')y comprises a sense strand oligonucleotide selected from the group consisting of oligonucleotides having SEQ ID NOs: 3053-4152, 5253-5545, 8605-10318, and 12033-12084.

In a second aspect, provided is a method for treating a lung disorder, disease or injury in a patient in need thereof comprising administering to the patient a therapeutically-effective combination of at least one TLR2 inhibitor or a pharmaceutically acceptable salt or prodrug thereof, and at least one TLR4 inhibitor or a pharmaceutically acceptable salt or prodrug thereof, thereby treating the lung disorder, disease or injury in the patient. In various embodiments, the lung disorder, disease or injury is selected from acute respiratory distress syndrome (ARDS), acute lung injury, pulmonary fibrosis (idiopathic), bleomycin induced pulmonary fibrosis, mechanical ventilator induced lung injury, chronic obstructive pulmonary disease (COPD), chronic bronchitis, a disorder associated with lung transplantation and emphysema. In some embodiments, the lung disorder, disease or injury is a disorder associated with lung transplantation. In various embodiments, the lung disorder associated with lung transplantation is selected from the group consisting of inflammation, graft rejection, primary graft failure, ischemia-reperfusion injury, reperfusion injury, reperfusion edema, allograft dysfunction, acute graft dysfunction, pulmonary reimplantation response, bronchiolitis obliterans and primary graft dysfunction (PGD). In one embodiment, the lung disorder associated with lung transplantation is PGD.

In some embodiments of the provided method for treating a lung disorder, disease or injury in a patient in need thereof, the at least one TLR2 inhibitor and the at least one TLR4 inhibitor are co-administered to the recipient in the same formulation. In other embodiments, the at least one TLR2 inhibitor and the at least one TLR4 inhibitor are co-administered to the recipient in different formulations. In various embodiments, the at least one TLR2 inhibitor and the at least one TLR4 inhibitor are co-administered to the recipient by the same route. In other embodiments, the at least one TLR2 inhibitor and the at least one TLR4 inhibitor are co-administered to the recipient by different routes. In various embodiments the mode of administration of the at least one TLR2 inhibitor and the at least one TLR4 inhibitor is selected from the group comprising: separate, combined, simultaneous and sequential administration.

In some embodiments, the provided method for treating a lung disorder, disease or injury in a patient in need thereof, further comprises at least one additional treatment selected from the group consisting of surgery, steroid therapy, non-steroid therapy, antiviral therapy, antifungal therapy, antimicrobial therapy, immunosuppressant therapy, anti-infective therapy, anti-hypertensive therapy, nutritional supplements and any combination thereof. In some embodiments, the additional treatment comprises immunosuppressant therapy. In various embodiments, the additional treatment is administered prior to, subsequent to or concomitantly with administering of at least one TLR2 inhibitor and at least one TLR4 inhibitor.

In some embodiments of the provided method for treating a lung disorder, disease or injury in a patient in need thereof, the administering of at least one TLR2 inhibitor and at least one TLR4 inhibitor to the patient comprises systemic administration or local administration. In various embodiments the method of administration is selected from the group comprising intravenous, intraarterial, intraperitoneal, intramuscular, intraportal, subcutaneous, direct injection, intratracheal instillation, inhalation, intranasal, pulmonary and administration via pump into the lung. In some embodiments, the method of administration comprises inhalation. In some embodiments, the method of administration comprises intratracheal instillation.

In some embodiments of the provided method for treating a lung disorder, disease or injury in a patient in need thereof, the at least one TLR2 inhibitor and the at least one TLR4 inhibitor are each inhibitor is independently selected from the group consisting of a small organic molecule, a protein, an antibody or fragment thereof, a peptide, a peptidomimetic and a nucleic acid molecule. In some embodiments, at least one inhibitor comprises a nucleic acid molecule. In other embodiments, each inhibitor comprises a nucleic acid molecule. In various embodiments of the provided method for treating a lung disorder, disease or injury in a patient in need thereof, a first nucleic acid molecule is a double-stranded oligonucleotide that binds a nucleotide sequence encoding a TLR2 gene and a second nucleic acid molecule is a double-stranded oligonucleotide that binds a nucleotide sequence encoding a TLR4 gene. In some embodiments, the double-stranded oligonucleotides are linked one to the other in tandem or annealed in RNAistar formation.

In some embodiments of the provided method for treating a lung disorder, disease or injury in a patient in need thereof, the first double-stranded oligonucleotide comprises:
(a) a sense strand and an antisense strand;
(b) each strand is independently 17 to 40 nucleotides in length;
(c) a 17 to 40 nucleotide sequence of the antisense strand is complementary to a sequence of an mRNA encoding TLR2; and
(d) a 17 to 40 nucleotide sequence of the sense strand is complementary to the antisense strand;
and the second double-stranded oligonucleotide comprises:
(a) a sense strand and an antisense strand;
(b) each strand is independently 17 to 40 nucleotides in length;
(c) a 17 to 40 nucleotide sequence of the antisense strand is complementary to a sequence of an mRNA encoding TLR4; and
(d) a 17 to 40 nucleotide sequence of the sense strand is complementary to the antisense strand.

In various embodiments the mRNA polynucleotide sequence of TLR2 is set forth in SEQ ID NO:1 and the mRNA polynucleotide sequence of TLR4 is set forth in any one of SEQ ID NO:2, SEQ ID NO:3 and SEQ ID NO:4.

In some embodiments, the first double-stranded oligonucleotide and the second double-stranded oligonucleotide are co-administered to the patient in the same formulation. In other embodiments, the first double-stranded oligonucleotide and the second double-stranded oligonucleotide are co-administered to the patient in different formulations. In some embodiments, the first double-stranded oligonucleotide and the second double-stranded oligonucleotide are co-administered to the patient by the same route. In some embodiments, the first double-stranded oligonucleotide and the second double-stranded oligonucleotide are co-administered to the patient by different routes. In various embodiments, the mode of administration of the first double-stranded oligonucleotide and the second double-stranded oligonucleotide to the recipient of the lung transplant is selected from the group comprising: separate, combined, simultaneous and sequential administration.

In some embodiments, the first double-stranded oligonucleotide and the second double-stranded oligonucleotide are formulated for administering to the patient once. In other embodiments, the first double-stranded oligonucleotide and the second double-stranded oligonucleotide are formulated for administering to the patient at least once-a-day. In other embodiments, the first double-stranded oligonucleotide and the second double-stranded oligonucleotide are formulated for multiple administrations to the patient.

In some embodiments of the provided method for treating a lung disorder, disease or injury in a patient in need thereof, at least one double-stranded oligonucleotide comprises a structure (A1):

```
(A1)      5' (N)x-Z 3'           (antisense strand)

3' Z'-(N')y-z" 5'      (sense strand)
``` wherein each of N and N' is a ribonucleotide which may be unmodified or modified, or an unconventional moiety;
wherein each of (N)x and (N')y is an oligonucleotide in which each consecutive N or N' is joined to the next N or N' by a covalent bond;
wherein each of Z and Z' is independently present or absent, but if present is independently 1-5 consecutive nucleotides or unconventional moieties or a combination thereof covalently attached at the 3' terminus of the strand in which it is present.
wherein z" may be present or absent, but if present is a capping moiety covalently attached at the 5' terminus of (N')y; wherein each of x and y is independently an integer between 17 and 40;
wherein the sequence of (N')y is complementary to the sequence of (N)x; and wherein (N)x comprises an antisense sequence to an mRNA selected from an mRNA encoding TLR2 and an mRNA encoding TLR4.

In various embodiments of structure (A1), the mRNA polynucleotide sequence of TLR2 is set forth in SEQ ID NO:1 and the mRNA polynucleotide sequence of TLR4 is set forth in any one of SEQ ID NO:2, SEQ ID NO:3 and SEQ ID NO:4.

In some preferred embodiments of structure (A1), x=y=19.

In some embodiments of structure (A1), (N)x comprises an antisense oligonucleotide selected from the group consisting of oligonucleotides having SEQ ID NOs: 723-1440, 2247-3052, 7076-8312 and 8459-8604 and (N')y comprises a sense strand oligonucleotide selected from the group consisting of oligonucleotides having SEQ ID NOs: 5-722, 1441-2246, 5839-7075 and 8313-8458.

In some embodiments of the provided method for treating a lung disorder, disease or injury in a patient in need thereof, at least one double-stranded compound comprises a structure (A2):

```
(A2)     5' N1-(N)x-Z 3'         (antisense strand)

3' Z'-N2-(N')y-z" 5'    (sense strand)
``` wherein each of N2, N and N' is independently an unmodified or modified ribonucleotide, or an unconventional moiety;

wherein each of (N)x and (N')y is an oligonucleotide in which each consecutive N or N' is joined to the adjacent N or N' by a covalent bond;

wherein each of x and y is independently an integer between 17 and 39;

wherein the sequence of (N')y is complementary to the sequence of (N)x and wherein (N)x is complementary to a consecutive sequence in an mRNA selected from an mRNA encoding TLR2 and an mRNA encoding TLR4;

wherein N1 is covalently bound to (N)x and is mismatched to the mRNA selected from an mRNA encoding TLR2 and an mRNA encoding TLR4;

wherein N1 is a moiety selected from the group consisting of uridine, modified uridine, ribothymidine, modified ribothymidine, deoxyribothymidine, modified deoxyribothymidine, riboadenine, deoxyriboadenine and modified deoxyriboadenine, wherein z" may be present or absent, but if present is a capping moiety covalently attached at the 5' terminus of N2-(N')y; and wherein each of Z and Z' is independently present or absent, but if present is independently 1-5 consecutive nucleotides or unconventional moieties or a combination thereof covalently attached at the 3' terminus of the strand in which it is present.

In various embodiments of structure (A2), the mRNA polynucleotide sequence of TLR2 is set forth in SEQ ID NO:1 and the mRNA polynucleotide sequence of TLR4 is set forth in any one of SEQ ID NO:2, SEQ ID NO:3 and SEQ ID NO:4.

In some preferred embodiments of structure (A2), x=y=18.

In some embodiments of structure (A2), the sequence of (N)x comprises an antisense oligonucleotide selected from the group consisting of oligonucleotides having SEQ ID NOs: 4153-5252, 5546-5838, 10319-12032, and 12085-12136 and the sequence of (N')y comprises a sense oligonucleotide selected from the group consisting of oligonucleotides having SEQ ID NOs: 3053-4152, 5253-5545, 8605-10318, and 12033-12084.

In another aspect, provided is a composition comprising at least one TLR2 inhibitor or a pharmaceutically acceptable salt or prodrug thereof and at least one TLR4 inhibitor or a pharmaceutically acceptable salt or prodrug thereof; and a pharmaceutically acceptable carrier. In various embodiments, each inhibitor is independently selected from the group consisting of a small organic molecule; a protein, an antibody or fragments thereof, a peptide, a peptidomimetic and a nucleic acid molecule. In some embodiments, each inhibitor is independently selected from the group consisting of a small organic molecule; a protein; an antibody or fragment thereof; and a nucleic acid molecule.

In some embodiments of the provided composition, each inhibitor comprises a nucleic acid molecule. In some embodiments a first nucleic acid molecule is a double-stranded oligonucleotide that binds a nucleotide sequence encoding a TLR2 gene and a second nucleic acid molecule is a double-stranded oligonucleotide that binds a nucleotide sequence encoding a TLR4 gene. In some embodiments of the composition the nucleic acid molecules are linked in tandem or annealed in RNAistar formation.

In some embodiments of the provided composition, a first double-stranded oligonucleotide comprises:
(a) a sense strand and an antisense strand;
(b) each strand is independently 17 to 40 nucleotides in length;
(c) a 17 to 40 nucleotide sequence of the antisense strand is complementary to a sequence of an mRNA encoding TLR2; and (d) a 17 to 40 nucleotide sequence of the sense strand is complementary to the antisense strand;
and a second double-stranded oligonucleotide comprises:
(a) a sense strand and an antisense strand;
(b) each strand is independently 17 to 40 nucleotides in length;
(c) a 17 to 40 nucleotide sequence of the antisense strand is complementary to a sequence of an mRNA encoding TLR4; and
(d) a 17 to 40 nucleotide sequence of the sense strand is complementary to the antisense strand.

In various embodiments the mRNA polynucleotide sequence of TLR2 is set forth in SEQ ID NO:1 and the mRNA polynucleotide sequence of TLR4 is set forth in any one of SEQ ID NO:2, SEQ ID NO:3 and SEQ ID NO:4.

In some embodiments, the amount of each double-stranded oligonucleotide in the composition independently ranges from about 0.05 mg to about 10.0 mg.

In some embodiments of the provided composition, at least one double-stranded oligonucleotide independently comprises a structure (A1):

```
(A1)     5' (N)x-Z 3'           (antisense strand)

3' Z'-(N')y-z" 5'      (sense strand)
``` wherein each of N and N' is a ribonucleotide which may be unmodified or modified, or an unconventional moiety;

wherein each of (N)x and (N')y is an oligonucleotide in which each consecutive N or N' is joined to the next N or N' by a covalent bond;

wherein each of Z and Z' is independently present or absent, but if present is independently 1-5 consecutive nucleotides or unconventional moieties or a combination thereof covalently attached at the 3' terminus of the strand in which it is present.

wherein z" may be present or absent, but if present is a capping moiety covalently attached at the 5' terminus of (N')y;

wherein each of x and y is independently an integer between 17 and 40;

wherein the sequence of (N')y is complementary to the sequence of (N)x; and wherein (N)x comprises an antisense sequence to an mRNA selected from an mRNA encoding TLR2 and an mRNA encoding TLR4.

In various embodiments of the composition, in structure (A1), the mRNA polynucleotide sequence of TLR2 is set forth in SEQ ID NO:1 and the mRNA polynucleotide sequence of TLR4 is set forth in any one of SEQ ID NO:2, SEQ ID NO:3 and SEQ ID NO:4.

In some preferred embodiments of the composition, in structure (A1), x=y=19.

In some embodiments of the composition, at least one double-stranded oligonucleotide compound independently comprises a structure (A2):

```
(A2)     5' N1-(N)x-Z 3'        (antisense strand)

3' Z'-N2-(N')y-z" 5'   (sense strand)
``` wherein each of N2, N and N' is independently an unmodified or modified ribonucleotide, or an unconventional moiety;

wherein each of (N)x and (N')y is an oligonucleotide in which each consecutive N or N' is joined to the adjacent N or N' by a covalent bond;

wherein each of x and y is independently an integer between 17 and 39;

wherein the sequence of (N')y is complementary to the sequence of (N)x and (N)x is complementary to a consecutive sequence in an mRNA selected from an mRNA encoding TLR2 and an mRNA encoding TLR4;

wherein N1 is covalently bound to (N)x and is mismatched to an mRNA selected from an mRNA encoding TLR2 and an mRNA encoding TLR4;

wherein N1 is a moiety selected from the group consisting of uridine, modified uridine, ribothymidine, modified ribothymidine, deoxyribothymidine, modified deoxyribothymidine, riboadenine, deoxyriboadenine and modified deoxyriboadenine, wherein z" may be present or absent, but if present is a capping moiety covalently attached at the 5' terminus of N2-(N')y; and wherein each of Z and Z' is independently present or absent, but if present is independently 1-5 consecutive nucleotides or unconventional moieties or a combination thereof covalently attached at the 3' terminus of the strand in which it is present.

In various embodiments of the provided composition, in structure (A2), the mRNA polynucleotide sequence of TLR2 is set forth in SEQ ID NO:1 and the mRNA polynucleotide sequence of TLR4 is set forth in any one of SEQ ID NO:2, SEQ ID NO:3 and SEQ ID NO:4.

In some preferred embodiments of the provided composition, in structure (A2), x=y=18.

In some embodiments, the provided composition is formulated for administering to the recipient once. In other embodiments, the provided composition is formulated for administering to the recipient at least once-a-day. In yet other embodiments, the provided composition is formulated for multiple administrations to the recipient.

In another aspect, provided is a kit comprising at least two therapeutic agents, wherein at least one agent comprises a TLR2 inhibitor and a second agent comprises a TLR4 inhibitor; optionally with instructions for use.

In some embodiments of the provided kit, each therapeutic agent is independently selected from the group consisting of a small organic molecule, a protein, an antibody or fragment thereof, a peptide, a peptidomimetic and nucleic acid molecule. In some embodiments of the kit, at least one therapeutic agent comprises a nucleic acid molecule. In other embodiments of the provided kit, each therapeutic agent comprises a nucleic acid molecule.

In some embodiments of the provided kit, a first nucleic acid molecule is a double-stranded oligonucleotide that binds a nucleotide sequence encoding a TLR2 gene and a second nucleic acid molecule is a double-stranded oligonucleotide that binds a nucleotide sequence encoding a TLR4 gene. In some embodiments of the, the double stranded oligonucleotides are linked one to the other in tandem or annealed in RNAistar formation.

In some embodiments of the provided kit, the first double-stranded oligonucleotide comprises:
(a) a sense strand and an antisense strand;
(b) each strand is independently 17 to 40 nucleotides in length;
(c) a 17 to 40 nucleotide sequence of the antisense strand is complementary to a sequence of an mRNA encoding TLR24; and
(d) a 17 to 40 nucleotide sequence of the sense strand is complementary to the antisense strand;

and the second double-stranded oligonucleotide comprises:
(a) a sense strand and an antisense strand;
(b) each strand is independently 17 to 40 nucleotides in length;
(c) a 17 to 40 nucleotide sequence of the antisense strand is complementary to a sequence of an mRNA encoding TLR4; and
(d) a 17 to 40 nucleotide sequence of the sense strand is complementary to the antisense strand.

In various embodiments of the provided kit, the mRNA polynucleotide sequence of TLR2 is set forth in SEQ ID NO:1 and the mRNA polynucleotide sequence of TLR4 is set forth in any one of SEQ ID NO:2, SEQ ID NO:3 and SEQ ID NO:4.

In some embodiments of the kit, the first double-stranded oligonucleotide and the second double-stranded oligonucleotide are formulated for co-administration to a recipient in the same formulation. In other embodiments, the first double-stranded oligonucleotide and the second double-stranded oligonucleotide are co-administered to the patient in different formulations. In some embodiments, the first double-stranded oligonucleotide and the second double-stranded oligonucleotide are co-administered to the patient by the same route. In some embodiments, the first double-stranded oligonucleotide and the second double-stranded oligonucleotide are co-administered to the patient by different routes. In various embodiments, the mode of administration of the first double-stranded oligonucleotide and the second double-stranded oligonucleotide to the recipient of the lung transplant is selected from the group comprising: separate, combined, simultaneous and sequential administration.

In some embodiments of the provided kit, the first double-stranded oligonucleotide and the second double-stranded oligonucleotide are formulated for administering to the patient once. In other embodiments, the first double-stranded oligonucleotide and the second double-stranded oligonucleotide are formulated for administering to the patient at least once-a-day. In other embodiments, the first double-stranded oligonucleotide and the second double-stranded oligonucleotide are formulated for multiple administrations to the patient.

In some embodiments of the provided kit, at least one double-stranded oligonucleotide independently comprises a structure (A1):

(A1)    5' (N)x-Z 3'        (antisense strand)

3' Z'-(N')y-z" 5'   (sense strand)

wherein each of N and N' is a ribonucleotide which may be unmodified or modified, or an unconventional moiety;

wherein each of (N)x and (N')y is an oligonucleotide in which each consecutive N or N' is joined to the next N or N' by a covalent bond;

wherein each of Z and Z' is independently present or absent, but if present is independently 1-5 consecutive nucleotides or unconventional moieties or a combination thereof covalently attached at the 3' terminus of the strand in which it is present.

wherein z" may be present or absent, but if present is a capping moiety covalently attached at the 5' terminus of (N')y;

wherein each of x and y is independently an integer between 17 and 40;

wherein the sequence of (N')y is complementary to the sequence of (N)x; and wherein (N)x comprises an antisense sequence to an mRNA selected from an mRNA encoding TLR2 and an mRNA encoding TLR4.

In various embodiments of the provided kit, in structure (A1), the mRNA polynucleotide sequence of TLR2 is set forth in SEQ ID NO:1 and the mRNA polynucleotide sequence of TLR4 is set forth in any one of SEQ ID NO:2, SEQ ID NO:3 and SEQ ID NO:4.

In some preferred embodiments of the provided kit, in structure (A1), x=y=19.

In some embodiments of the provided kit, at least one double-stranded oligonucleotide independently comprises a structure (A2):

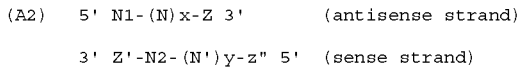

wherein each of N2, N and N' is independently an unmodified or modified ribonucleotide, or an unconventional moiety;

wherein each of (N)x and (N')y is an oligonucleotide in which each consecutive N or N' is joined to the adjacent N or N' by a covalent bond;

wherein each of x and y is independently an integer between 17 and 39;

wherein the sequence of (N')y is complementary to the sequence of (N)x and (N)x is complementary to a consecutive sequence in an mRNA selected from an mRNA encoding TLR2 and an mRNA encoding TLR4;

wherein N1 is covalently bound to (N)x and is mismatched to an mRNA selected from an mRNA encoding TLR2 and an mRNA encoding TLR4;

wherein N1 is a moiety selected from the group consisting of uridine, modified uridine, ribothymidine, modified ribothymidine, deoxyribothymidine, modified deoxyribothymidine, riboadenine, deoxyriboadenine and modified deoxyriboadenine, wherein z" may be present or absent, but if present is a capping moiety covalently attached at the 5' terminus of N2-(N')y; and wherein each of Z and Z' is independently present or absent, but if present is independently 1-5 consecutive nucleotides or unconventional moieties or a combination thereof covalently attached at the 3' terminus of the strand in which it is present.

In various embodiments of the provided kit, in structure (A2), the mRNA polynucleotide sequence of TLR2 is set forth in SEQ ID NO:1 and the mRNA polynucleotide sequence of TLR4 is set forth in any one of SEQ ID NO:2, SEQ ID NO:3 and SEQ ID NO:4.

In some preferred embodiments of the provided kit, in structure (A2), x=y=18.

In another aspect, provided is a package comprising A) at least two separate dosage units selected from (i) at least one dosage unit comprising a TLR2 inhibitor and (ii) at least one dosage unit comprising a TLR4 inhibitor; and optionally B) a package insert comprising instructions for use of the dosage units.

In various embodiments of the provided package, the TLR2 inhibitor is a double-stranded oligonucleotide that binds a nucleotide sequence encoding a TLR2 gene and the TLR4 inhibitor is a double-stranded oligonucleotide that binds a nucleotide sequence encoding a TLR4 gene.

In some embodiments of the provided package, the TLR2 inhibitor is a double-stranded oligonucleotide comprising:
(a) a sense strand and an antisense strand;
(b) each strand is independently 17 to 40 nucleotides in length;
(c) a 17 to 40 nucleotide sequence of the antisense strand is complementary to a sequence of an mRNA encoding TLR2; and
(d) a 17 to 40 nucleotide sequence of the sense strand is complementary to the antisense strand;

and the TLR4 inhibitor is a double-stranded oligonucleotide comprising:
(a) a sense strand and an antisense strand;
(b) each strand is independently 17 to 40 nucleotides in length;
(c) a 17 to 40 nucleotide sequence of the antisense strand is complementary to a sequence of an mRNA encoding TLR4; and
(d) a 17 to 40 nucleotide sequence of the sense strand is complementary to the antisense strand.

In some embodiments of the provided package, the dosage units are co-administered to a patient by the same route. In other embodiments of the package, the dosage units are co-administration to a patient by different routes. In various embodiments, the mode of administration of the dosage units is selected from the group comprising: separate, combined, simultaneous and sequential administration.

In some embodiments of the provided package, the dosage units are designed for administering to the patient once. In other embodiments, the dosage units are for administering to the patient at least once-a-day. In other embodiments, the dosage units are for multiple administrations to the patient.

In some embodiments of the provided package, at least one double-stranded oligonucleotide independently comprises a structure (A1):

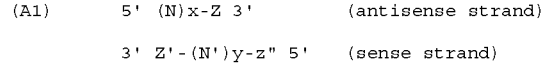

wherein each of N and N' is a ribonucleotide which may be unmodified or modified, or an unconventional moiety;

wherein each of (N)x and (N')y is an oligonucleotide in which each consecutive N or N' is joined to the next N or N' by a covalent bond;

wherein each of Z and Z' is independently present or absent, but if present is independently 1-5 consecutive nucleotides or unconventional moieties or a combination thereof covalently attached at the 3' terminus of the strand in which it is present.

wherein z" may be present or absent, but if present is a capping moiety covalently attached at the 5' terminus of (N')y;

wherein each of x and y is independently an integer between 17 and 40;

wherein the sequence of (N')y is complementary to the sequence of (N)x; and wherein (N)x comprises an antisense sequence to an mRNA selected from an mRNA encoding TLR2 and an mRNA encoding TLR4.

In some embodiments of the provided package, at least one double-stranded oligonucleotide independently comprises a structure (A2):

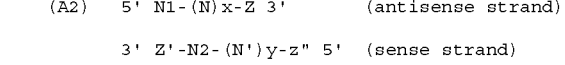

wherein each of N2, N and N' is independently an unmodified or modified ribonucleotide, or an unconventional moiety;

wherein each of (N)x and (N')y is an oligonucleotide in which each consecutive N or N' is joined to the adjacent N or N' by a covalent bond;

wherein each of x and y is independently an integer between 17 and 39;

wherein the sequence of (N')y is complementary to the sequence of (N)x and (N)x is complementary to a consecutive sequence in an mRNA selected from an mRNA encoding TLR2 and an mRNA encoding TLR4;
wherein N1 is covalently bound to (N)x and is mismatched to an mRNA selected from an mRNA encoding TLR2 and an mRNA encoding TLR4;
wherein N1 is a moiety selected from the group consisting of uridine, modified uridine, ribothymidine, modified ribothymidine, deoxyribothymidine, modified deoxyribothymidine, riboadenine, deoxyriboadenine and modified deoxyriboadenine,
wherein z" may be present or absent, but if present is a capping moiety covalently attached at the 5' terminus of N2-(N')y; and
wherein each of Z and Z' is independently present or absent, but if present is independently 1-5 consecutive nucleotides or unconventional moieties or a combination thereof covalently attached at the 3' terminus of the strand in which it is present.

In various embodiments of the provided kit or the provided package, the instructions or package insert indicates that the therapeutic agents or dosage units are suitable for use in treating a patient suffering from a lung disease, injury or disorder selected from the group consisting of acute respiratory distress syndrome (ARDS), acute lung injury, pulmonary fibrosis (idiopathic), bleomycin induced pulmonary fibrosis, mechanical ventilation induced lung injury, chronic obstructive pulmonary disease (COPD), chronic bronchitis, a disorder associated with lung transplantation and emphysema. In some embodiments of the provided kit or the provided package, the instructions or package insert indicate that the therapeutic agents or dosage units are suitable for use in treating a patient suffering from a disorder associated with lung transplantation.

In some embodiments of the provided kit or the provided package, the lung disorder associated with lung transplantation is selected from the group consisting of inflammation, graft rejection, primary graft failure, ischemia-reperfusion injury, reperfusion injury, reperfusion edema, allograft dysfunction, acute graft dysfunction, pulmonary reimplantation response, bronchiolitis obliterans and primary graft dysfunction (PGD).

In another aspect, provided is a method of preventing or reducing the symptoms of primary graft dysfunction (PGD) in a recipient of a lung transplant, comprising administering to the recipient a therapeutically-effective amount of at least one TLR2 inhibitor or a pharmaceutically acceptable salt or prodrug thereof, thereby preventing or reducing the symptoms of PGD in the recipient.

In some embodiments of the provided method, the recipient of a lung transplant is a human that is being treated for primary graft dysfunction (PGD). In some embodiments, the method is for preventing or reducing the symptoms of cold ischemia-associated PGD. In other embodiments the method is for preventing or reducing the symptoms of warm ischemia-associated PGD. In various embodiments of the provided method, the symptoms are selected from the group consisting of inflammation, acute graft rejection, graft rejection, ischemia-reperfusion injury, reperfusion injury, impaired pulmonary function, bronchiolitis obliterans, impaired blood oxygenation, increased inflammatory cytokine production, intra-graft and intra-airway accumulation of granulocytes, pulmonary edema and hypoxemia.

In some embodiments of the provided method, the administration of a therapeutically-effective amount of at least one TLR2 inhibitor or a pharmaceutically acceptable salt or prodrug thereof, results in one or more of the following: reduced pulmonary edema, increased blood oxygenation, preserved blood oxygenation, improved pulmonary function, preserved pulmonary function in the recipient of a lung transplant and improved pulmonary function of the transplanted lung.

In various embodiments of the provided method, the at least one TLR2 inhibitor is administered to the recipient of a lung transplant prior to, during or following the lung transplantation.

In various embodiments the provided method of preventing or reducing the symptoms of primary graft dysfunction (PGD) in a recipient of a lung transplant, further comprises at least one additional treatment selected from the group consisting of surgery, steroid therapy, non-steroid therapy, antiviral therapy, antifungal therapy, antimicrobial therapy, immunosuppressant therapy, anti-infective therapy, anti-hypertensive therapy, nutritional supplements and any combination thereof. In various embodiments, the additional treatment is administered prior to, subsequent to or concomitantly with administering of at least one TLR2 inhibitor. In some embodiments, the additional treatment comprises immunosuppressant therapy.

In various embodiments of the provided method, the route of administration of at least one TLR2 inhibitor is selected from: systemic administration or local administration.

In various embodiments, the method of administration of at least one TLR2 inhibitor to the recipient of a lung transplant is selected from the group comprising: intravenous, intraarterial, intraperitoneal, intramuscular, intraportal, subcutaneous, direct injection, intratracheal instillation, inhalation, intranasal, pulmonary and administration via pump into the lung. In some embodiments, at least one TLR2 inhibitor is administered to the recipient of a lung transplant by inhalation. In another embodiments, at least one TLR2 inhibitor is administered to the recipient of a lung transplant by intratracheal instillation.

In various embodiments of the provided method of preventing or reducing the symptoms of primary graft dysfunction (PGD) in a recipient of a lung transplant, the at least one TLR2 inhibitor is selected from the group consisting of a small organic molecule, a protein, an antibody or fragment thereof, a peptide, a peptidomimetic and a nucleic acid molecule. In some embodiments, at least one inhibitor comprises a nucleic acid molecule. In some embodiments, the nucleic acid molecule is a double-stranded oligonucleotide that binds a nucleotide sequence encoding a TLR2 gene.

In various embodiments of the provided method of preventing or reducing the symptoms of primary graft dysfunction (PGD) in a recipient of a lung transplant, the double-stranded oligonucleotide comprises:
(a) a sense strand and an antisense strand;
(b) each strand is independently 17 to 40 nucleotides in length;
(c) a 17 to 40 nucleotide sequence of the antisense strand is complementary to a sequence of an mRNA encoding TLR2; and
(d) a 17 to 40 nucleotide sequence of the sense strand is complementary to the antisense strand.

In various embodiments of the provided method, the double-stranded oligonucleotide is formulated for administering to the recipient once. In some embodiments of the provided method, the double-stranded oligonucleotide is formulated for administering to the recipient at least once-a-day. In yet other embodiments, the double-stranded oligonucleotide is formulated for multiple administrations to the recipient.

In various embodiments of the provided method, the double-stranded oligonucleotide comprises a structure (A1):

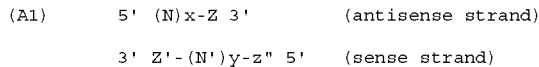

wherein each of N and N' is a ribonucleotide which may be unmodified or modified, or an unconventional moiety;

wherein each of (N)x and (N')y is an oligonucleotide in which each consecutive N or N' is joined to the next N or N' by a covalent bond;

wherein each of Z and Z' is independently present or absent, but if present is independently 1-5 consecutive nucleotides or unconventional moieties or a combination thereof covalently attached at the 3' terminus of the strand in which it is present.

wherein z" may be present or absent, but if present is a capping moiety covalently attached at the 5' terminus of (N')y; wherein each of x and y is independently an integer between 17 and 40;

wherein the sequence of (N')y is complementary to the sequence of (N)x; and wherein (N)x comprises an antisense sequence to an mRNA encoding TLR2.

In various embodiments of the provided method, in structure (A1), the mRNA polynucleotide sequence of TLR2 is set forth in SEQ ID NO:1.

In some preferred embodiments of the provided method, in structure (A1), x=y=19.

In various embodiments of the provided method, in structure (A1), (N)x comprises an antisense oligonucleotide present in SEQ ID NOs: 723-1440 and 2247-3052 and (N')y comprises a sense strand oligonucleotide present in SEQ ID NOs: 5-722 and 1441-2246.

In various embodiments of the provided method, the double-stranded compound comprises a structure (A2):

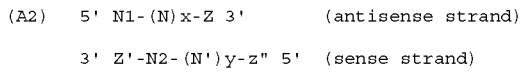

wherein each of N2, N and N' is independently an unmodified or modified ribonucleotide, or an unconventional moiety;

wherein each of (N)x and (N')y is an oligonucleotide in which each consecutive N or N' is joined to the adjacent N or N' by a covalent bond;

wherein each of x and y is independently an integer between 17 and 39;

wherein the sequence of (N')y is complementary to the sequence of (N)x and wherein (N)x is complementary to a consecutive sequence in an mRNA encoding TLR2;

wherein N1 is covalently bound to (N)x and is mismatched to the mRNA encoding TLR2;

wherein N1 is a moiety selected from the group consisting of uridine, modified uridine, ribothymidine, modified ribothymidine, deoxyribothymidine, modified deoxyribothymidine, riboadenine, deoxyriboadenine and modified deoxyriboadenine, wherein z" may be present or absent, but if present is a capping moiety covalently attached at the 5' terminus of N2-(N')y; and wherein each of Z and Z' is independently present or absent, but if present is independently 1-5 consecutive nucleotides or unconventional moieties or a combination thereof covalently attached at the 3' terminus of the strand in which it is present.

In various embodiments of the provided method, in structure (A2), the mRNA polynucleotide sequence of TLR2 is set forth in SEQ ID NO:1

In some preferred embodiments of the provided method, in structure (A2), x=y=18.

In various embodiments of the provided method, in structure (A2), the sequence of (N)x is selected from anyone of SEQ ID NOs: 4153-5252 and 5546-5838 and the sequence of (N')y is selected from anyone of SEQ ID NOs: 3053-4152 and 5253-5545.

In various embodiments of the provided method, administration of the at least one double-stranded oligonucleotide that binds a nucleotide sequence encoding a TLR2 gene results in down-regulation of TLR2 expression.

In another aspect provided is a kit or package comprising at least one dosage unit comprising a TLR2 inhibitor; optionally with instructions for use, wherein the instructions indicate that the dosage unit is suitable for use in treating a patient suffering from a lung disease, injury or disorder selected from the group consisting of respiratory distress syndrome (ARDS), acute lung injury, pulmonary fibrosis (idiopathic), bleomycin induced pulmonary fibrosis, mechanical ventilator induced lung injury, chronic obstructive pulmonary disease (COPD), chronic bronchitis, a disorder associated with lung transplantation and emphysema.

In some embodiments the provided kit or package are for use in treating a patient suffering from a disorder associated with lung transplantation.

In various embodiments of the provided kit or package, the TLR2 inhibitor is selected from the group consisting of a small organic molecule, a protein, an antibody or fragment thereof, a peptide, a peptidomimetic and nucleic acid molecule. In some embodiments of the kit or package, the TLR2 inhibitor is selected from the group consisting of a small organic molecule, a protein; an antibody or fragment thereof; and a nucleic acid molecule. In other embodiments of the kit or package, the TLR2 inhibitor comprises a nucleic acid molecule.

In some embodiments of the provided kit or package, the nucleic acid molecule is a double-stranded oligonucleotide that binds a nucleotide sequence encoding a TLR2 gene. In some embodiments of he kit or package, the double-stranded oligonucleotide comprises:

(a) a sense strand and an antisense strand;
(b) each strand is independently 17 to 40 nucleotides in length;
(c) a 17 to 40 nucleotide sequence of the antisense strand is complementary to a sequence of an mRNA encoding TLR2; and
(d) a 17 to 40 nucleotide sequence of the sense strand is complementary to the antisense strand.

In some embodiments of the provided kit or package, the double-stranded oligonucleotide is formulated for administering to the patient once. In some embodiments, the double-stranded oligonucleotide is formulated for administering to the patient at least once-a-day. In some embodiments of the provided kit or package, the double-stranded oligonucleotide is formulated for multiple administrations to the patient.

In some embodiments of the provided kit or package, the double-stranded oligonucleotide comprises a structure (A1):

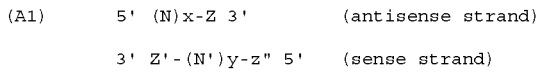

wherein each of N and N' is a ribonucleotide which may be unmodified or modified, or an unconventional moiety;

wherein each of (N)x and (N')y is an oligonucleotide in which each consecutive N or N' is joined to the next N or N' by a covalent bond;

wherein each of Z and Z' is independently present or absent, but if present is independently 1-5 consecutive nucleotides or unconventional moieties or a combination thereof covalently attached at the 3' terminus of the strand in which it is present.

wherein z" may be present or absent, but if present is a capping moiety covalently attached at the 5' terminus of (N')y;

wherein each of x and y is independently an integer between 17 and 40;

wherein the sequence of (N')y is complementary to the sequence of (N)x; and wherein (N)x comprises an antisense sequence to an mRNA encoding TLR2.

In some embodiments of the provided kit or package, the double-stranded oligonucleotide comprises a structure (A2):

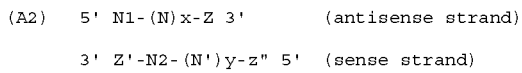

wherein each of N2, N and N' is independently an unmodified or modified ribonucleotide, or an unconventional moiety;

wherein each of (N)x and (N')y is an oligonucleotide in which each consecutive N or N' is joined to the adjacent N or N' by a covalent bond;

wherein each of x and y is independently an integer between 17 and 39;

wherein the sequence of (N')y is complementary to the sequence of (N)x and (N)x is complementary to a consecutive sequence in an mRNA encoding TLR2;

wherein N1 is covalently bound to (N)x and is mismatched to an mRNA encoding TLR2;

wherein N1 is a moiety selected from the group consisting of uridine, modified uridine, ribothymidine, modified ribothymidine, deoxyribothymidine, modified deoxyribothymidine, riboadenine, deoxyriboadenine and modified deoxyriboadenine, wherein z" may be present or absent, but if present is a capping moiety covalently attached at the 5' terminus of N2-(N')y; and wherein each of Z and Z' is independently present or absent, but if present is independently 1-5 consecutive nucleotides or unconventional moieties or a combination thereof covalently attached at the 3' terminus of the strand in which it is present.

In some embodiments, the provided kit or package is for use in treating a patient suffering from a disorder associated with lung transplantation. In various embodiments the disorder associated with lung transplantation is selected from the group consisting of inflammation, graft rejection, primary graft failure, ischemia-reperfusion injury, reperfusion injury, reperfusion edema, allograft dysfunction, acute graft dysfunction, pulmonary reimplantation response, bronchiolitis obliterans and primary graft dysfunction (PGD).

In another aspect provided is a use of a composition comprising at least one TLR2 inhibitor or a pharmaceutically acceptable salt or prodrug thereof and at least one TLR4 inhibitor or a pharmaceutically acceptable salt or prodrug thereof; and a pharmaceutically acceptable carrier, for the preparation of a medicament for treating or preventing or reducing the symptoms of primary graft dysfunction (PGD) in a recipient of a lung transplant.

In another aspect provided is a use of a composition comprising at least one TLR2 inhibitor or a pharmaceutically acceptable salt or prodrug thereof and at least one TLR4 inhibitor or a pharmaceutically acceptable salt or prodrug thereof; and a pharmaceutically acceptable carrier, for treating or preventing or reducing the symptoms of primary graft dysfunction (PGD) in a recipient of a lung transplant.

In various embodiments of the provided use, the recipient of a lung transplant is a human that is being treated for primary graft dysfunction (PGD). In some embodiments, the use is for preventing or reducing the symptoms of cold ischemia-associated PGD. In other embodiments, the use is for preventing or reducing the symptoms of warm ischemia-associated PGD.

In various embodiments of the use, the symptoms are selected from the group consisting of inflammation, acute graft rejection, graft rejection, ischemia-reperfusion injury, reperfusion injury, impaired pulmonary function, bronchiolitis obliterans, impaired blood oxygenation, increased inflammatory cytokine production, intra-graft and intra-airway accumulation of granulocytes, pulmonary edema and hypoxemia.

In another aspect provided is a use of a composition comprising at least one TLR2 inhibitor or a pharmaceutically acceptable salt or prodrug thereof and at least one TLR4 inhibitor or a pharmaceutically acceptable salt or prodrug thereof; and a pharmaceutically acceptable carrier, for the preparation of a medicament for treating or preventing a lung disease, disorder or injury selected from acute respiratory distress syndrome (ARDS), acute lung injury, pulmonary fibrosis (idiopathic), bleomycin induced pulmonary fibrosis, mechanical ventilator induced lung injury, chronic obstructive pulmonary disease (COPD), chronic bronchitis, and emphysema.

In another aspect provided is a use of a composition comprising at least one TLR2 inhibitor or a pharmaceutically acceptable salt or prodrug thereof and at least one TLR4 inhibitor or a pharmaceutically acceptable salt or prodrug thereof; and a pharmaceutically acceptable carrier, for treating or preventing a lung disease, disorder or injury selected from acute respiratory distress syndrome (ARDS), acute lung injury, pulmonary fibrosis (idiopathic), bleomycin induced pulmonary fibrosis, mechanical ventilator induced lung injury, chronic obstructive pulmonary disease (COPD), chronic bronchitis, and emphysema.

While administration of a single dsRNA targeting TLR4 (8th and 9th columns), was not effective in preserving pulmonary function. Control groups were composed of (i) mice that were administered with vehicle (general negative control, 2nd column), and (ii) mice that underwent lung transplantation (Tx) after only 1 hour of cold preservation (1 hour cold ischemia time (CIT)) (reperfusion control, 1st column).

Figure 3:
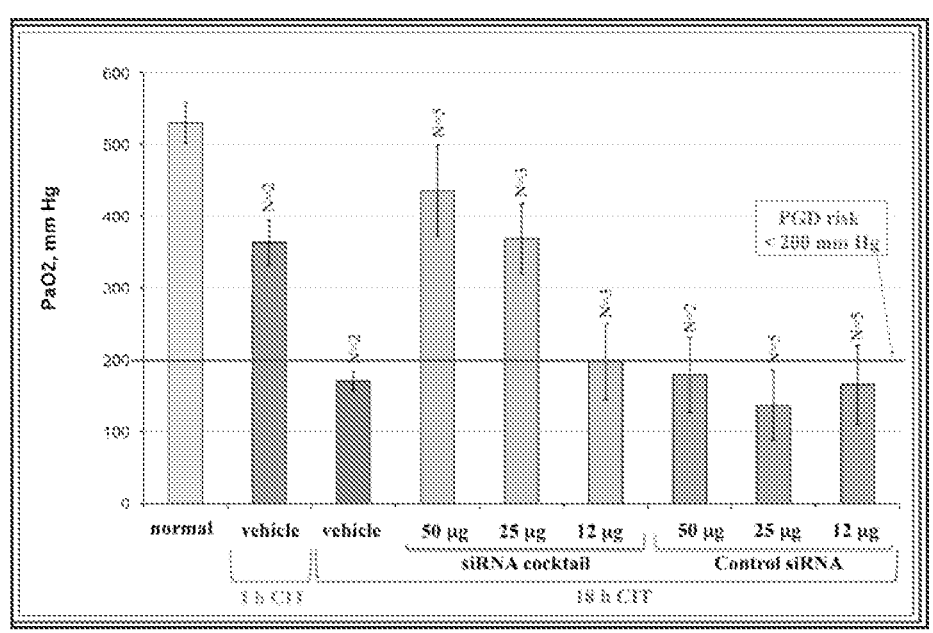

FIG. 3 shows that dual target dsRNA combination, targeting TLR2 and TLR4 genes (columns 4-6), restored pulmonary function in the recipient's lung. Oxygenation of the arterial blood in mice was measured at 24 h after lung transplantation and dsRNA administration. Negative control groups were composed of normal (intact) mice (general negative control, column 1), as well as mice that underwent lung transplantation (Tx) after only 1 hour of cold preservation (1 hour cold ischemia time (CIT)) (reperfusion control, column 2) and mice that were treated with a vehicle (18 hour cold ischemia time (CIT), column 3).

Figure 4:
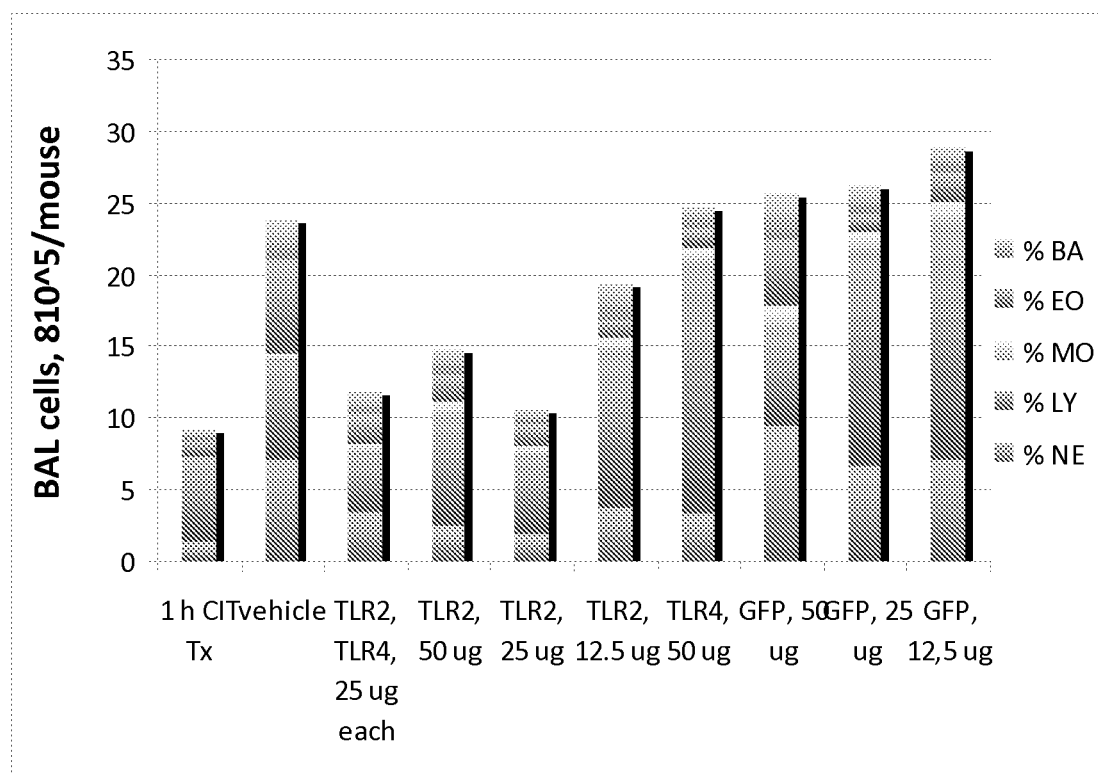

FIG. 4 shows that a combination of dsRNA specific for TLR2 and dsRNA specific for TLR4 (TLR2_4_S73 and TLR4_4_S500) (column 3), as well as an individual treatment comprising dsRNA specific for TLR2 (TLR2_4_S73) (columns 4-6), diminishes intra-airway accumulation of granulocytes in the BAL obtained from transplanted lungs. At 24 h after lung transplantation, BAL was collected from all the mice. Total amount of cells, as well as amounts of different cell populations (neutrophils, lymphocytes, monocytes, eosinophils, basophils) were measured by FACS. Differential cell counts are presented as fractions of total cell counts.

Figure 5:
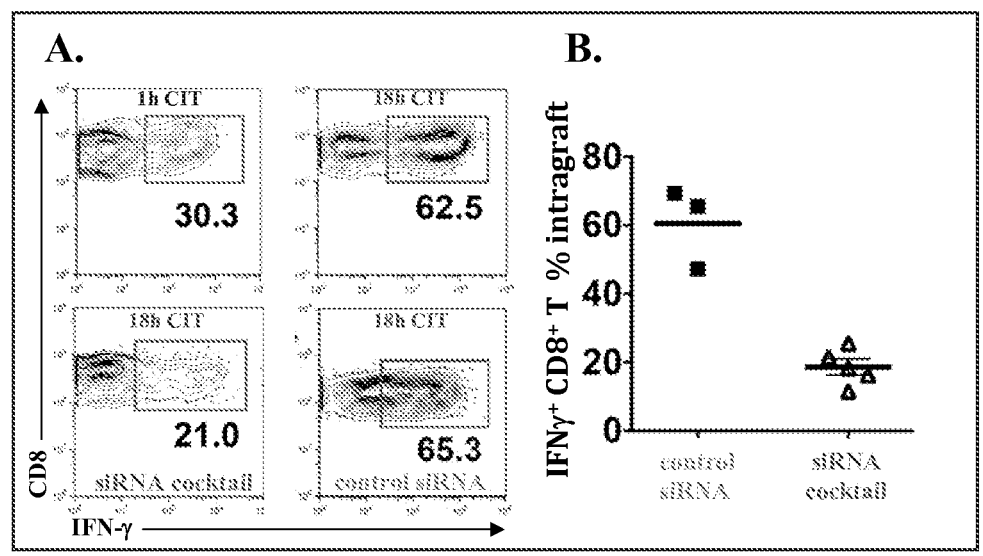

FIG. 5 shows that treatment with a combination of dsRNA specific for TLR2 and dsRNA specific for TLR4 (TLR2_4_S73 and TLR4_4_S500 (identified in the figure as "siRNA cocktail")) diminished abundance of intragraft IFNγ+ CD8+ T cells on day 7 post allogeneic transplantation. (A). FACS demonstrating representative percent abundance of intragraft IFNγ+ CD8+ T cells (N>6); (B) Plotted percent abundance of intragraft IFNγ+ CD8+ T cells.

Figure 6:
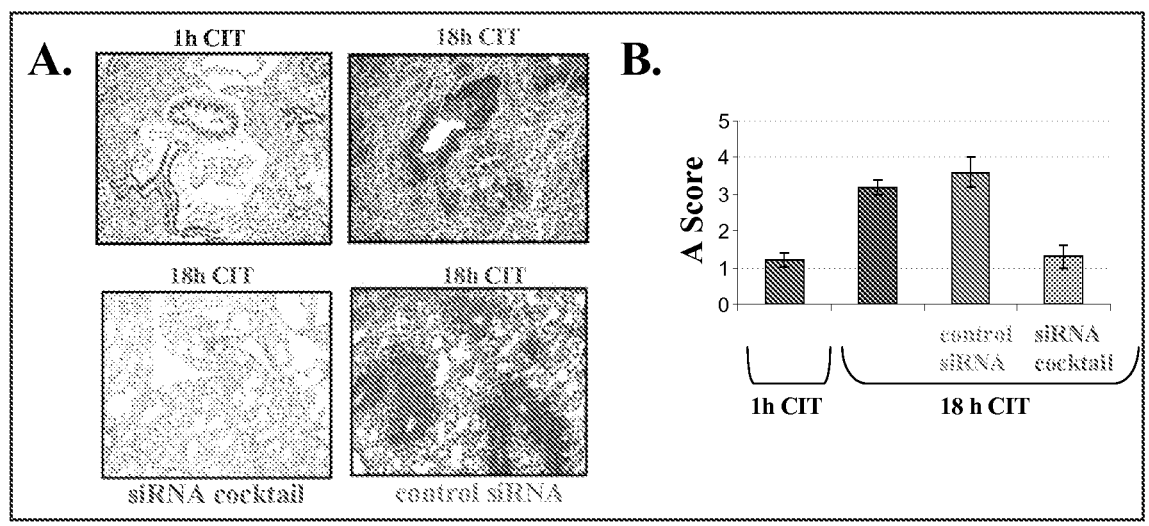

FIG. 6 shows that treatment with a combination of dsRNA specific for TLR2 and dsRNA specific for TLR4 (TLR2_4_S73 and TLR4_4_S500) on days 0 and 1, significantly reduced histopathological signs of acute graft rejection in co-stimulation blockade—treated 1 h CIT or 18H CIT Balb/c->B6 transplants, treated intratracheally with either control dsRNA (EGFP_5_S763), or a combination of dsRNA specific for TLR2 and dsRNA specific for TLR4 (TLR2_4_S73 and TLR4_4_S500) (identified as "siRNA cocktail"). (A.) Representative histopathological images (HE) of the recipient lungs on day 7 post allogeneic lung transplantation. (B). Rejection scores evaluated by board-certified lung transplant pathologist in a blinded fashion. The scoring system is typically used in the clinic, as follows: Grade A0 (none), Grade A1 (minimal), Grade A2 (mild), Grade A3 (moderate) and Grade A4 (severe).

DETAILED DESCRIPTION OF THE INVENTION

The present disclosures relate in part to a method for treating a lung disorder, disease or injury in a mammal in need thereof. The method may include administering to the mammal at least one therapeutic agents selected from a TLR2 inhibitor or a pharmaceutically acceptable salt or prodrug thereof; in an amount effective to treat the mammal. The method may include administering to the mammal at least two therapeutic agents wherein at least one therapeutic agent targets the TLR2 gene or gene product and at least one therapeutic agent targets the TLR4 gene or gene product. In some embodiments the therapeutic agents include: (i) a TLR2 inhibitor or a pharmaceutically acceptable salt or prodrug thereof, and (ii) a TLR4 inhibitor or a pharmaceutically acceptable salt or prodrug thereof; in amounts effective to treat the lung disorder, disease or injury in the mammal. The present disclosures also relate to combinations, compositions, kits and packages that include the therapeutic agents.

In some embodiments, methods may include administering to the mammal at least one therapeutic agents in an amount sufficient to reduce expression and/or to inhibit function of TLR2 gene. In some embodiments methods may include administering to the mammal a combination of at least two therapeutic agents or a combined therapeutic agent in an amount sufficient to reduce expression and/or to inhibit function of both a TLR2 gene and a TLR4 gene. In certain embodiments the lung disease or injury is selected from the group consisting of acute respiratory distress syndrome (ARDS), acute lung injury, pulmonary fibrosis (idiopathic), bleomycin induced pulmonary fibrosis, mechanical ventilator induced lung injury, chronic obstructive pulmonary disease (COPD), chronic bronchitis, emphysema, lung transplantation-induced acute graft dysfunction and bronchiolitis obliterans after lung transplantation. In certain embodiments, provided are compositions and methods for combination therapy for treating or preventing inflammation and/or graft rejection associated with organ transplantation, in particular lung transplantation, including treatment, prevention or attenuation of progression of primary graft failure, ischemia-reperfusion injury, reperfusion injury, reperfusion edema, allograft dysfunction, pulmonary reimplantation response, bronchiolitis obliterans after lung transplantation and/or primary graft dysfunction (PGD) after organ transplantation, in particular in lung transplantation.

In some embodiments the at least one therapeutic agent is a TLR2 inhibitor. In some embodiments the at least two therapeutic agents are a TLR2 inhibitor and a TLR4 inhibitor. In some embodiments the at least two therapeutic agents are co-administered, e.g. concomitantly or in sequence. In other embodiments, the at least two therapeutic agents are administered in a pharmaceutical composition comprising a combination thereof. In some embodiments the therapeutic agent is a combined inhibitor by which it is meant a single agent which is capable of down-regulating the expression and/or activity of both gene TLR2 and gene TLR4 and/or gene products thereof. Non-limiting examples of such single agents are tandem and multi-armed RNAi molecules disclosed in PCT Patent Publication No. WO 2007/091269.

In one embodiment the method comprises administering a therapeutically effective amount of a therapeutic agent, which targets TLR2.

In some embodiments the method comprises administering (a) a therapeutically effective amount of a first therapeutic agent, which targets TLR2 and (b) a therapeutically effective amount of a second therapeutic agent, which targets TLR4.

In one embodiment the method comprises administering a therapeutically effective amount of a combined inhibitor, which targets both TLR2 and TLR4.

In some embodiments the therapeutic agent is a TLR2 inhibitor. In some embodiments the therapeutic agent is selected from the group consisting of a small organic molecule chemical compound; a protein; an antibody or fragment thereof; a peptide; a peptidomimetic and a nucleic acid molecule. In some embodiments at least one therapeutic agent is a nucleic acid molecule. In some embodiments the therapeutic agent comprises a nucleic acid molecule. In some embodiments the nucleic acid molecule is independently selected from the group consisting of an antisense molecule, a short interfering nucleic acid (siNA), short interfering RNA (siRNA), double-stranded RNA (dsRNA), micro-RNA (miRNA) or short hairpin RNA (shRNA) that bind a nucleotide sequence (such as an mRNA sequence) encoding the gene TLR2, for example the mRNA coding sequence for human TLR2 exemplified by SEQ ID NO:1 (gi|68160956|ref|NM_003264.3|).

In some embodiments the at least two therapeutic agents are a TLR2 inhibitor and a TLR4 inhibitor. In some embodiments each therapeutic agent is independently selected from the group consisting of a small organic molecule; a protein; an antibody or fragment thereof; a peptide; a peptidomimetic and a nucleic acid molecule. In some embodiments at least one therapeutic agent is a nucleic acid molecule. In some embodiments each therapeutic agent comprises a nucleic acid molecule.

In some embodiments each nucleic acid molecule is independently selected from the group consisting of an antisense molecule, a short interfering nucleic acid (siNA), short interfering RNA (siRNA), double-stranded RNA (dsRNA), micro-RNA (miRNA) or short hairpin RNA (shRNA) that bind a nucleotide sequence (such as an mRNA sequence) encoding a target gene selected from TLR2 and TLR4, for example: the mRNA coding sequence for human TLR2 exemplified by SEQ ID NO:1 or the mRNA coding sequence for human TLR4 exemplified by SEQ ID NOs:2-4. In various embodiments each nucleic acid molecule is a dsRNA molecule or a siRNA molecule.

In various embodiments each therapeutic agent comprises a nucleic acid molecule, wherein:

(a) the nucleic acid molecule includes a sense strand and an antisense strand;

(b) each strand of the nucleic acid molecule is independently 17 to 40 nucleotides in length;

(c) a 17 to 40 nucleotide sequence of the antisense strand is complementary to a sequence of an mRNA selected from an mRNA encoding TLR2 (e.g., SEQ ID NO: 1) or an mRNA encoding TLR4 (e.g., SEQ ID NOs: 2-4); and (d) a 17 to 40 nucleotide sequence of the sense strand is complementary to the antisense strand and includes a 17 to 40 nucleotide sequence of a mRNA selected from a mRNA encoding TLR2 (e.g., SEQ ID NO: 1) and an mRNA encoding TLR4 (e.g., SEQ ID NOs: 2-4).

In various embodiments each therapeutic agent comprises a nucleic acid molecule having a structure (A1):

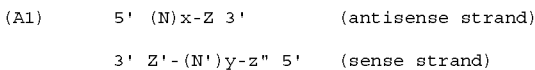

(A1)    5' (N)x-Z 3'         (antisense strand)

3' Z'-(N')y-z" 5'    (sense strand)

wherein each of N and N' is a ribonucleotide which may be unmodified or modified, or an unconventional moiety;

wherein each of (N)x and (N')y is an oligonucleotide in which each consecutive N or N' is joined to the next N or N' by a covalent bond;

wherein each of Z and Z' is independently present or absent, but if present is independently 1-5 consecutive nucleotides or unconventional moieties or a combination thereof covalently attached at the 3' terminus of the strand in which it is present.

wherein z" may be present or absent, but if present is a capping moiety covalently attached at the 5' terminus of (N')y;

wherein each of x and y is independently an integer between 17 and 40;

wherein the sequence of (N')y is complementary to the sequence of (N)x; and wherein (N)x comprises an antisense sequence to an mRNA selected from an mRNA encoding TLR2 and an mRNA encoding TLR4.

In some embodiments the sequence of TLR2 mRNA is set forth in SEQ ID NO:1. In various embodiments the sense and antisense strands of the TLR2 siRNA oligonucleotides are selected from the sense strand sequences set forth in SEQ ID NOs: 5-722; 1441-2246; 3053-4152; and 5253-5545 and antisense strand sequences set forth in SEQ ID NOs: 723-1440; 2247-3052; 4153-5252 and 5546-5838. In some embodiments the sequence of TLR4 mRNA is set forth in SEQ ID NO:2; SEQ ID NO:3 or SEQ ID NO:4. In various embodiments the sense and antisense strands of the TLR4 siRNA oligonucleotides are selected from the sense strand sequences set forth in SEQ ID NOs: 5839-7075, 8313-8458, 8605-10318, 12033-12084 and antisense strand sequences set forth in SEQ ID NOs: 7076-8312, 8459-8604, 10319-12032, 12085-12136.

In some embodiments (N)x of the double-stranded oligonucleotide compound comprises an antisense oligonucleotide present in SEQ ID NOs: 723-1440, 2247-3052, 4153-5252, 5546-5838, 7076-8312, 8459-8604, 10319-12032, 12085-12136. In some embodiments the sequence of (N')y is partially complementary to the sequence of (N)x. In some embodiments the sequence of (N')y is substantially complementary to the sequence of (N)x. In some embodiments the sequence of (N')y is fully complementary to the sequence of (N)x. In some embodiments (N)x of the double-stranded oligonucleotide compound comprises an antisense oligonucleotide present in double-stranded RNA compounds identified as TLR2_4, TLR2_7 or TLR4_4.

In some embodiments of the double-stranded oligonucleotide compound x=y=19. In various embodiments both Z and Z' are present in the double-stranded oligonucleotide compound. In various embodiments both Z and Z' are absent in the double-stranded oligonucleotide compound; i.e. the double-stranded compound is blunt ended on both ends. In some embodiments at least one of Z or Z' is present in said double-stranded oligonucleotide compound.

In some embodiments Z or Z' is independently an unconventional moiety selected from an abasic deoxyribose moiety, an abasic ribose moiety an inverted abasic deoxyribose moiety, an inverted abasic ribose moiety; a C3 moiety, a C4 moiety, a C5 moiety, an amino-6 moiety. In some preferred embodiments Z or Z' is independently selected from a C3 moiety and an amino-C6 moiety.

In some embodiments at least one of N or N' in the double-stranded oligonucleotide compound comprises a 2' sugar modified ribonucleotide. In some embodiments the 2' sugar modification comprises the presence of an amino, a fluoro, an alkoxy or an alkyl moiety. In some preferred embodiments 2' sugar modification comprises the presence of an alkoxy moiety, preferably the alkoxy moiety comprises a 2'-O-Methyl moiety.

In some embodiments of the double-stranded oligonucleotide compound, (N)x comprises alternating 2'-O-Methyl sugar modified ribonucleotides and unmodified ribonucleotides. In certain embodiments, (N)x comprises at least 5 alternating 2'-O-Methyl sugar modified and unmodified ribonucleotides. In some embodiments, (N)x comprises 2'-O-Methyl sugar modified ribonucleotides at positions 2, 4, 6, 8, 11, 13, 15, 17 and 19. In some embodiments, (N)x comprises 2'-O-Methyl sugar modified ribonucleotides at positions 1, 3, 5, 7, 9, 11, 13, 15, 17 and 19. In some embodiments, (N)x comprises 2'-O-Methyl sugar modified pyrimidine ribonucleotides. In some embodiments, all pyrimidine ribonucleotides in (N)x comprise 2'-O-Methyl sugar modified pyrimidine ribonucleotides.

In some embodiments, (N)x comprises at least one unconventional moiety selected from a mirror nucleotide and a nucleotide joined to an adjacent nucleotide by a 2'-5' internucleotide phosphate bond. In some embodiments, the unconventional moiety in (N)x is a mirror nucleotide. In some embodiments, the mirror nucleotide in (N)x is an L-deoxyribonucleotide (L-DNA). In various embodiments, (N)x comprises an L-DNA moiety at position 6 or 7 (5'>3').

In some embodiments, (N')y comprises at least one unconventional moiety selected from a mirror nucleotide and a nucleotide joined to an adjacent nucleotide by a 2'-5' internucleotide phosphate bond. In some embodiments, the unconventional moiety in (N')y is a mirror nucleotide. In some embodiments, the mirror nucleotide in (N')y is an L-deoxyribonucleotide (L-DNA). In some embodiments, (N')y consists of unmodified ribonucleotides at positions 1-17 and 19 and one L-DNA at the 3' penultimate position (position 18). In some embodiments, (N')y consists of unmodified ribonucleotides at position 1-16 and 19 and two consecutive L-DNA at the 3' penultimate positions (positions 17 and 18). In some embodiments the unconventional moiety in (N')y is a nucleotide joined to an adjacent nucleotide by a 2'-5' internucleotide phosphate linkage. In some embodiments, in (N')y the nucleotide joined to an adjacent nucleotide by a 2'-5' internucleotide phosphate linkage further comprises a 3'-O-Methyl (3'O-Me) sugar modification.

In various embodiments the therapeutic agent is a double-stranded oligonucleotide compound having a structure (A2) set forth below:

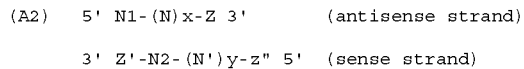

```
(A2)    5' N1-(N)x-Z 3'        (antisense strand)

3' Z'-N2-(N')y-z" 5'   (sense strand)
``` wherein each of N2, N and N' is independently an unmodified or modified ribonucleotide, or an unconventional moiety;

wherein each of (N)x and (N')y is an oligonucleotide in which each consecutive N or N' is joined to the adjacent N or N' by a covalent bond;

wherein each of x and y is independently an integer between 17 and 39;

wherein the sequence of (N')y is complementary to the sequence of (N)x and (N)x is complementary to a consecutive sequence in an mRNA selected from an mRNA encoding TLR2 (e.g., SEQ ID NO: 1) and an mRNA encoding TLR4 (e.g., SEQ ID NOs: 2-4);

wherein N1 is covalently bound to (N)x and is mismatched to an mRNA selected from an mRNA encoding TLR2 (e.g., SEQ ID NO: 1) and an mRNA encoding TLR4 (e.g., SEQ ID NOs: 2-4);

wherein N1 is a moiety selected from the group consisting of uridine, modified uridine, ribothymidine, modified ribothymidine, deoxyribothymidine, modified deoxyribothymidine, riboadenine, deoxyriboadenine and modified deoxyriboadenine, wherein z" may be present or absent, but if present is a capping moiety covalently attached at the 5' terminus of N2-(N')y; and wherein each of Z and Z' is independently present or absent, but if present is independently 1-5 consecutive nucleotides or unconventional moieties or a combination thereof covalently attached at the 3' terminus of the strand in which it is present.

In some embodiments of the double-stranded oligonucleotide compound according to Structure (A)2, x=y=18.

In some embodiments (N)x is complementary to a consecutive sequence in SEQ ID NO:1 (human TLR2 mRNA). In some embodiments (N)x includes an antisense oligonucleotide selected from any one of SEQ ID NOs: 4153-5252 and 5546-5838. In some embodiments x=y=18 and N1-(N)x includes an antisense oligonucleotide selected from any one of SEQ ID NOs: 723-1440 and 2247-3052. In some embodiments x=y=19 or x=y=20. In certain preferred embodiments x=y=18.

In some embodiments (N)x is complementary to a consecutive sequence in SEQ ID NO:2 (human TLR4, transcript variant 4, non-coding RNA) or SEQ ID NO:3 (human TLR4, transcript variant 1, mRNA) or SEQ ID NO:4 (human TLR4, transcript variant 3, non-coding RNA). In some embodiments (N)x includes an antisense oligonucleotide selected from any one of SEQ ID NOs: 10319-12032 and 12085-12136. In some embodiments x=y=18 and N1-(N)x includes an antisense oligonucleotide selected from any one of SEQ ID NOs: 7076-8312 and 8459-8604. In some embodiments x=y=19 or x=y=20. In certain preferred embodiments x=y=18.

In some embodiments N1 and N2 form a Watson-Crick base pair. In other embodiments N1 and N2 form a non-Watson-Crick base pair. In some embodiments N1 is a modified riboadenosine or a modified ribouridine.

In certain embodiments N1 is selected from the group consisting of riboadenosine, modified riboadenosine, deoxyriboadenosine, modified deoxyriboadenosine. In other embodiments N1 is selected from the group consisting of ribouridine, deoxyribouridine, modified ribouridine, and modified deoxyribouridine.

In certain embodiments, N1 is selected from the group consisting of riboadenosine, modified riboadenosine, deoxyriboadenosine, modified deoxyriboadenosine and N2 is selected from the group consisting of ribouridine, deoxyribouridine, modified ribouridine, and modified deoxyribouridine. In certain embodiments N1 is selected from the group consisting of riboadenosine and modified riboadenosine and N2 is selected from the group consisting of ribouridine and modified ribouridine.

In certain embodiments, N2 is selected from the group consisting of riboadenosine, modified riboadenosine, deoxyriboadenosine, modified deoxyriboadenosine and N1 is selected from the group consisting of ribouridine, deoxyribouridine, modified ribouridine, and modified deoxyribouridine. In certain embodiments, N1 is selected from the group consisting of ribouridine and modified ribouridine and N2 is selected from the group consisting of riboadenine and modified riboadenine. In certain embodiments, N1 is ribouridine and N2 is riboadenine.

In some embodiments of (A2), (N)x is selected from any one of SEQ ID NOs: 4153-5252 and 5546-5838 and (N')y is a substantially complementary sequence selected from SEQ ID NOs: 3053-4152 and 5253-5545. In some embodiments of (A2), (N)x is selected from any one of SEQ ID NOs: 10319-12032 and 12085-12136 and (N')y is a substantially complementary sequence selected from SEQ ID NOs: 8605-10318 and 12033-12084. In some embodiments the sequence of (N')y is partially complementary to the sequence of (N)x. In some embodiments the sequence of (N')y is fully complementary to the sequence of (N)x. In some embodiments, (N)x of the double-stranded oligonucleotide compound comprises an antisense oligonucleotide present in double-stranded RNA compounds identified as TLR2__4, TLR2__7 or TLR4__4.

In some embodiments, the administration method is systemic administration. In some embodiments, the administration method is local administration. In various embodiments the administration method is intratracheal, inhalant, intravenous, intraarterial, intraperitoneal, intramuscular, intraportal, subcutaneous, intradermal, topical, direct administration into a target lung tissue by injection or via a pump.

In one aspect provided is a pharmaceutical composition that includes at least one therapeutic agent selected from a TLR2 inhibitor or a pharmaceutically acceptable salt or prodrug thereof and a pharmaceutically acceptable carrier.

In another aspect provided is a combination that includes at least two therapeutic agents selected from: (i) a TLR2 inhibitor or a pharmaceutically acceptable salt or prodrug thereof and (ii) a TLR4 inhibitor or a pharmaceutically acceptable salt or prodrug thereof and a pharmaceutically acceptable carrier.

In another aspect provided is a pharmaceutical composition that includes a combination of at least two therapeutic agents selected from: (i) a TLR2 inhibitor or a pharmaceutically acceptable salt or prodrug thereof and (iii) a TLR4 inhibitor or a pharmaceutically acceptable salt or prodrug thereof and a pharmaceutically acceptable carrier.

In some embodiments the composition comprises a therapeutic agent consisting of a TLR2 inhibitor. In some embodiments the combination or composition comprises at least two therapeutic agents, wherein at least one of the therapeutic agents is a TLR2 inhibitor or a pharmaceutically acceptable salt or prodrug thereof, and at least one of the therapeutic agents is a TLR4 inhibitor or a pharmaceutically acceptable salt or prodrug thereof. In some embodiments the combination or composition comprises a TLR2 inhibitor and a TLR4 inhibitor.

In some embodiments the TLR2 inhibitor is selected from the group consisting of a small molecule chemical compound; a protein; an antibody or fragment thereof; and a nucleic acid molecule. In some embodiments the TLR2 inhibitor comprises a nucleic acid molecule. In some embodiments the nucleic acid molecule is selected from a short interfering nucleic acid (siNA), a short interfering RNA (siRNA), a double-stranded RNA (dsRNA), a micro-RNA (miRNA) or short hairpin RNA (shRNA) that binds a nucleotide sequence (such as an mRNA sequence) encoding the target gene TLR2. In some embodiments the nucleic acid molecule is a double-stranded RNA (dsRNA) or a short interfering RNA (siRNA) targeting TLR2.

In some embodiments each therapeutic agent is independently selected from the group consisting of a small molecule chemical compound; a protein; an antibody or fragment thereof; and a nucleic acid molecule. In some embodiments each therapeutic agent comprises a nucleic acid molecule. In some embodiments each nucleic acid molecule is independently selected from a short interfering nucleic acid (siNA), a short interfering RNA (siRNA), a double-stranded RNA (dsRNA), a micro-RNA (miRNA) or short hairpin RNA (shRNA) that binds a nucleotide sequence (such as an mRNA sequence) encoding the target gene selected from TLR2 and TLR4. In some embodiments each nucleic acid molecule is a double-stranded RNA (dsRNA) or a short interfering RNA (siRNA). In some embodiments the at least two dsRNA or siRNA are a dsRNA or siRNA targeting TLR2 and a dsRNA or siRNA targeting TLR4.

In one embodiment the method comprises a therapeutically effective amount of a therapeutic agent, which down-regulates TLR2.

In one embodiment the method comprises (a) a therapeutically effective amount of a first therapeutic agent, which down-regulates TLR2 and (b) a therapeutically effective amount of a second therapeutic agent, which down-regulates TLR4.

In another aspect provided is a kit comprising at a therapeutic agent consisting of a TLR2 inhibitor; optionally with instructions for use.

In another aspect provided is a kit comprising at least two therapeutic agents wherein the two agents are selected from the group consisting of a TLR2 inhibitor and a TLR4 inhibitor; optionally with instructions for use.

In some embodiments of the kit each therapeutic agent is independently selected from the group consisting of a small molecule chemical compound; a protein; an antibody or fragment thereof; and a nucleic acid molecule. In some embodiments each therapeutic agent comprises a nucleic acid molecule. In some embodiments each nucleic acid molecule is independently selected from a short interfering nucleic acid (siNA), a short interfering RNA (siRNA), a double-stranded RNA (dsRNA), a micro-RNA (miRNA) or short hairpin RNA (shRNA) that binds a nucleotide sequence (such as an mRNA sequence) encoding a target gene selected from TLR2 and TLR4. In some embodiments each nucleic acid molecule is a double-stranded RNA (dsRNA) or a short interfering RNA (siRNA). In some embodiments each nucleic acid molecule is selected from the group consisting of a dsRNA targeting TLR2 or a siRNA targeting TLR2; and a dsRNA targeting TLR4 or a siRNA targeting TLR4. In some embodiments the at least two siRNA consist of: a dsRNA or siRNA targeting TLR2; and a dsRNA or siRNA targeting TLR4.

In some embodiments a kit provided herein comprises a combined inhibitor by which it is meant a single agent which is capable of down-regulating at least two genes and/or gene products selected from the group consisting both TLR2 and TLR4; optionally with instructions for use.

In some embodiments each therapeutic agent of the kit comprises a nucleic acid molecule, wherein:

(a) the nucleic acid molecule includes a sense strand and an antisense strand;

(b) each strand of the nucleic acid molecule is independently 17 to 40 nucleotides in length;

(c) a 17 to 40 nucleotide sequence of the antisense strand is complementary to a sequence of an mRNA selected from an mRNA encoding TLR2 (e.g., SEQ ID NO: 1) and an mRNA encoding TLR4 (e.g., SEQ ID NOs: 2-4); and (d) a 17 to 40 nucleotide sequence of the sense strand is complementary to the antisense strand and includes a 17 to 40 nucleotide sequence of a mRNA selected from a mRNA encoding TLR2 (e.g., SEQ ID NO: 1) and an mRNA encoding TLR4 (e.g., SEQ ID NOs: 2-4).

In some embodiments each therapeutic agent of the kit comprises a nucleic acid molecule having a structure (A1):

```
(A1)     5' (N)x-Z 3'         (antisense strand)

3' Z'-(N')y-z" 5'    (sense strand)
``` wherein each of N and N' is a ribonucleotide which may be unmodified or modified, or an unconventional moiety;

wherein each of (N)x and (N')y is an oligonucleotide in which each consecutive N or N' is joined to the next N or N' by a covalent bond;

wherein each of Z and Z' is independently present or absent, but if present is independently 1-5 consecutive nucleotides or unconventional moieties or a combination thereof covalently attached at the 3' terminus of the strand in which it is present.

wherein z" may be present or absent, but if present is a capping moiety covalently attached at the 5' terminus of (N')y;

wherein each of x and y is independently an integer between 17 and 40;

wherein the sequence of (N')y is complementary to the sequence of (N)x; and wherein (N)x comprises an antisense sequence to an mRNA selected from an mRNA encoding TLR2 and an mRNA encoding TLR4.

In various embodiments the double-stranded molecule comprises a mismatch to the target mRNA at the 5' terminal nucleotide of the guide strand (antisense strand). Accordingly, in some embodiments each therapeutic agent of the kit comprises a double-stranded oligonucleotide compound having a structure (A2) set forth below

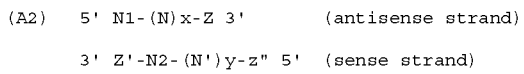

wherein each of N2, N and N' is independently an unmodified or modified ribonucleotide, or an unconventional moiety;

wherein each of (N)x and (N')y is an oligonucleotide in which each consecutive N or N' is joined to the adjacent N or N' by a covalent bond;

wherein each of x and y is independently an integer between 17 and 39;

wherein the sequence of (N')y is complementary to the sequence of (N)x and (N)x is complementary to a consecutive sequence in an mRNA selected from an mRNA encoding TLR2 (e.g., SEQ ID NO: 1) and an mRNA encoding TLR4 (e.g., SEQ ID NOs: 2-4);

wherein N1 is covalently bound to (N)x and is mismatched to an mRNA selected from an mRNA encoding TLR2 (e.g., SEQ ID NO: 1) and an mRNA encoding TLR4 (e.g., SEQ ID NOs: 2-4);

wherein N1 is a moiety selected from the group consisting of uridine, modified uridine, ribothymidine, modified ribothymidine, deoxyribothymidine, modified deoxyribothymidine, riboadenine, deoxyriboadenine and modified deoxyriboadenine, wherein z" may be present or absent, but if present is a capping moiety covalently attached at the 5' terminus of N2-(N')y; and wherein each of Z and Z' is independently present or absent, but if present is independently 1-5 consecutive nucleotides or unconventional moieties or a combination thereof covalently attached at the 3' terminus of the strand in which it is present.

In another aspect provided is a package comprising A) at least two separate dosage units selected from (i) a dosage unit comprising a TLR2 inhibitor, and (ii) a dosage unit comprising a TLR4 inhibitor; and optionally B) a package insert comprising instructions for use of the dosage units.

In another embodiment of the package each inhibitor comprises a nucleic acid molecule, wherein:

(a) the nucleic acid molecule includes a sense strand and an antisense strand;

(b) each strand of the nucleic acid molecule is independently 17 to 40 nucleotides in length;

(c) a 17 to 40 nucleotide sequence of the antisense strand is complementary to a sequence of an mRNA selected from an mRNA encoding TLR2 and an mRNA encoding TLR4; and (d) a 17 to 40 nucleotide sequence of the sense strand is complementary to the antisense strand and includes a 17 to 40 nucleotide sequence of a mRNA selected from an mRNA encoding TLR2 and an mRNA encoding TLR4.

In some embodiments of the package each inhibitor comprises a nucleic acid molecule having a structure (A1):

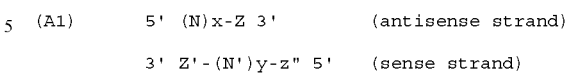

wherein each of N and N' is a ribonucleotide which may be unmodified or modified, or an unconventional moiety;

wherein each of (N)x and (N')y is an oligonucleotide in which each consecutive N or N' is joined to the next N or N' by a covalent bond;

wherein each of Z and Z' is independently present or absent, but if present is independently 1-5 consecutive nucleotides or unconventional moieties or a combination thereof covalently attached at the 3' terminus of the strand in which it is present.

wherein z" may be present or absent, but if present is a capping moiety covalently attached at the 5' terminus of (N')y;

wherein each of x and y is independently an integer between 17 and 40;

wherein the sequence of (N')y is complementary to the sequence of (N)x; and wherein (N)x comprises an antisense sequence to an mRNA selected from an mRNA encoding TLR2 and an mRNA encoding TLR4.

In various embodiments the double-stranded molecule comprises a mismatch to the target mRNA at the 5' terminal nucleotide of the guide strand (antisense strand). Accordingly, in some embodiments of the package each inhibitor comprises a double-stranded oligonucleotide compound having a structure (A2) set forth below:

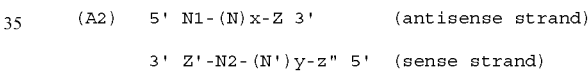

wherein each of N2, N and N' is independently an unmodified or modified ribonucleotide, or an unconventional moiety;

wherein each of (N)x and (N')y is an oligonucleotide in which each consecutive N or N' is joined to the adjacent N or N' by a covalent bond;

wherein each of x and y is independently an integer between 17 and 39;

wherein the sequence of (N')y is complementary to the sequence of (N)x and (N)x is complementary to a consecutive sequence in an mRNA selected from an mRNA encoding TLR2 and an mRNA encoding TLR4;

wherein N1 is covalently bound to (N)x and is mismatched to an mRNA selected from an mRNA encoding TLR2 and an mRNA encoding TLR4;

wherein N1 is a moiety selected from the group consisting of uridine, modified uridine, ribothymidine, modified ribothymidine, deoxyribothymidine, modified deoxyribothymidine, riboadenine, deoxyriboadenine and modified deoxyriboadenine, wherein z" may be present or absent, but if present is a capping moiety covalently attached at the 5' terminus of N2-(N')y; and wherein each of Z and Z' is independently present or absent, but if present is independently 1-5 consecutive nucleotides or unconventional moieties or a combination thereof covalently attached at the 3' terminus of the strand in which it is present.

In various embodiments of the kit or package the instructions or package insert indicates that the therapeutic agent or dosage unit or the therapeutic agents or dosage units are suitable for use in treating a patient suffering from a disease or condition selected from the group consisting of acute respiratory distress syndrome (ARDS), acute lung injury, pulmonary fibrosis (idiopathic), bleomycin induced pulmonary fibrosis, mechanical ventilator induced lung injury, chronic obstructive pulmonary disease (COPD), chronic bronchitis, emphysema, lung transplantation-induced acute graft dysfunction and bronchiolitis obliterans after lung transplantation. In various embodiments of the kit or package the instructions or package insert indicates that the therapeutic agents or dosage units are suitable for use in treating a patient suffering from or at risk of suffering from inflammation and/or graft rejection associated with organ transplantation, in particular lung transplantation, including, without being limited to, primary graft failure, ischemia-reperfusion injury, reperfusion injury, reperfusion edema, allograft dysfunction, pulmonary reimplantation response, bronchiolitis obliterans after lung transplantation and/or primary graft dysfunction (PGD) after organ transplantation, in particular in lung transplantation.

In various embodiments the composition comprises one or more double-stranded nucleic acid (dsNA) agents which down-regulate or inhibit the expression/activity/function of a TLR2 gene and/or TLR2 gene product including DNA and mRNA.

In various embodiments the combination comprises one or more double-stranded nucleic acid (dsNA) agents which down-regulate or inhibit the expression/activity/function of at least two genes and/or gene products including DNA and mRNA selected from: (i) TLR2 and (ii) TLR4.

The mRNA coding sequence for human TLR2 is exemplified by SEQ ID NO:1 and the mRNA coding sequence for human TLR4 is exemplified by SEQ ID NO:2, SEQ ID NO:3 and SEQ ID NO:4.

In one embodiment the composition comprises at least one dsNA molecule which down-regulates TLR2.

In another embodiment the combination comprises one or more dsNA agents which down-regulate TLR2 and TLR4. In one embodiment the combination comprises at least one dsNA molecule which down-regulates TLR2 and at least one dsNA molecule which down-regulates TLR4.

In some embodiments provided is a tandem dsRNA comprising dsRNA targeting at least both TLR2 and TLR4.

In some embodiments provided is a triple armed structure, also known as RNAistar. Said triple-stranded oligonucleotide comprises an oligoribonucleotide having the general structure:

| 5' | oligo1 (sense) | LINKER A | oligo2 (sense) | 3' |
|---|---|---|---|---|
| 3' | oligo1 (antisense) | LINKER B | oligo3 (sense) | 5' |
| 3' | oligo3 (antisense) | LINKER C | oligo2 (antisense) | 5' |
| or | | | | |
| 5' | oligo1 (sense) | LINKER A | oligo2 (antisense) | 3' |
| 3' | oligo1 (antisense) | LINKER B | oligo3 (sense) | 5' |
| 3' | oligo3 (antisense) | LINKER C | oligo2 (sense) | 5' |
| or | | | | |
| 5' | oligo1 (sense) | LINKER A | oligo3 (antisense) | 3' |
| 3' | oligo1 (antisense) | LINKER B | oligo2 (sense) | 5' |
| 5' | oligo3 (sense) | LINKER C | oligo2 (antisense) | 3' |

Wherein one or more of linker A, linker B or linker C is present; any combination of two or more oligonucleotides and one or more of linkers A-C is possible, so long as the polarity of the strands and the general structure of the molecule remains. Further, if two or more of linkers A-C are present, they may be identical or different. In some embodiments a "gapped" RNAistar compound is preferred wherein the compound comprises three RNA duplexes.

A compound consisting of four ribonucleotide strands forming three RNA duplexes having the general structure:

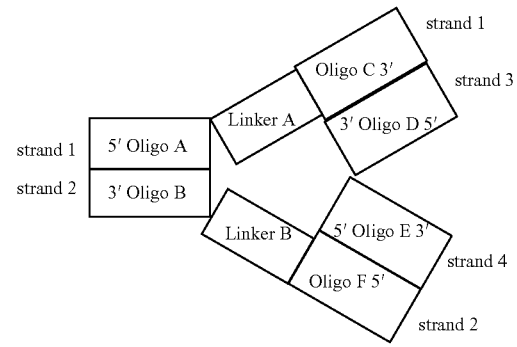

wherein each of oligo A, oligo B, oligo C, oligo D, oligo E and oligo F represents at least 19 consecutive ribonucleotides, wherein from 18 to 40 of such consecutive ribonucleotides, in each of oligo A, B, C, D, E and F comprise a strand of a RNA duplex, wherein each ribonucleotide may be modified or unmodified' wherein strand 1 comprises oligo A which is either a sense portion or an antisense portion of a first RNA duplex of the compound, strand 2 comprises oligo B which is complementary to at least 19 nucleotides in oligo A, and oligo A and oligo B together form a first RNA duplex that targets a first target mRNA;

wherein strand 1 further comprises oligo C which is either a sense portion or an antisense strand portion of a second RNA duplex of the compound, strand 3 comprises oligo D which is complementary to at least 19 nucleotides in oligo C and oligo C and oligo D together form a second RNA duplex that targets a second target mRNA;

wherein strand 4 comprises oligo E which is either a sense portion or an antisense strand portion of a third RNA duplex of the compound, strand 2 further comprises oligo F which is complementary to at least 19 nucleotides in oligo E and oligo E and oligo F together form a third RNA duplex that targets a third target mRNA; and wherein linker A is a moiety that covalently links oligo A and oligo C; linker B is a moiety that covalently links oligo B and oligo F, and linker A and linker B can be the same or different.

In some embodiments the first, second and third RNA duplex target the same gene, i.e. TLR2. In other embodiments two of the first, second or third siRNA duplexes target the same mRNA, e.g. TLR2 and the third RNA duplex targets a different mRNA, for example TLR4. In other embodiments two of the first, second or third siRNA duplexes target the same mRNA, e.g. TLR4 and the third RNA duplex targets a different mRNA, for example TLR2.

"Toll-like receptor 2" or "tlr-2" or "TLR-2" or "tlr2" or "TLR2" are used interchangeably and refer to any Toll-like receptor 2 peptide or polypeptide having any TLR2 protein activity. TLR2 has also been designated as CD282 (cluster of differentiation 282). Toll-like receptor 2 (or more particularly human TLR2) may have an amino acid sequence that is the same, or substantially the same, as SEQ ID NO. 1.

"Toll-like receptor 4" or "tlr-4" or "TLR-4" or "tlr4" or "TLR4" are used interchangeably and refer to any Toll-like receptor 4 peptide or polypeptide having any TLR4 protein activity. TLR4 has also been designated as CD284 (cluster of differentiation 284). Toll-like receptor 4 (or more particularly human TLR4) may have an amino acid sequence that is the same, or substantially the same, as SEQ ID NO. 2-4.

As used herein the term "nucleotide sequence encoding TLR2 and TLR4" means a nucleotide sequence that codes for a TLR2 and TLR4 protein, respectively, or portion thereof. The term "nucleotide sequence encoding TLR2 and TLR4" is also meant to include TLR2 and TLR4 coding sequences such as TLR2 and TLR4 isoforms, mutant TLR2 and TLR4 genes, splice variants of TLR2 and TLR4 genes, and TLR2 and TLR4 gene polymorphisms. A nucleic acid sequence encoding TLR2 and TLR4 includes mRNA sequences encoding TLR2 and TLR4, which can also be referred to as TLR2 mRNA and TLR4 mRNA. Exemplary sequence of human TLR2 is SEQ ID NO:1. Exemplary sequences of human TLR4 mRNA are SEQ ID NO:2, SEQ ID NO:3 and SEQ ID NO:4.

In some embodiments the inhibitors or therapeutic agents disclosed herein comprise a molecule, a compound which can down-regulate or inhibit expression and/or function of a gene and/or gene product selected from TLR2 and TLR4. Preferably the therapeutic agent is independently selected from the group consisting of a small organic molecule; a protein; an antibody or fragment thereof; a peptide, a peptidomimetic and a nucleic acid molecule.

Examples of an antibody includes polyclonal, monoclonal, chimeric, humanized or human antibodies and antigen-binding fragments thereof. Examples of TLR2 binding antibodies are anti-human TLR2 antibody, mouse monoclonal anti-human TLR2, rabbit anti-human TLR2, goat anti-human TLR2 and the like which are raised against TLR2.

Examples of an antibody includes polyclonal, monoclonal, chimeric, humanized or human antibodies and antigen-binding fragments thereof. Examples of TLR4 binding antibodies are anti-human TLR4 antibody, mouse monoclonal anti-human TLR4, rabbit anti-human TLR4, goat anti-human TLR4 and the like which are raised against TLR4.

In some embodiments the inhibitor or therapeutic agent of the present disclosure comprise a peptide. The term "peptide", as used herein, refers to a compound consisting of from about two to about ninety amino acid residues wherein the amino group of one amino acid is linked to the carboxyl group of another amino acid by a peptide bond. Preferred peptide sequences are short (e.g. 3 to 20 amino acids in length) and lipophilic, such that they can cross cell membranes to a sufficient extent. A peptide can be, for example, derived or removed from a native protein by enzymatic or chemical cleavage, or can be prepared using conventional peptide synthesis techniques (e.g., solid phase synthesis) or molecular biology techniques (see Sambrook, J. et al., Molecular Cloning: A Laboratory Manual, Cold Spring Harbor Press, Cold Spring Harbor, N.Y. (1989)). A "peptide" can comprise any suitable L- and/or D-amino acid, for example, common o-amino acids (e.g., alanine, glycine, valine), non-α-amino acids (e.g., β-alanine, 4-aminobutyric acid, 6-aminocaproic acid, sarcosine, statine), and unusual amino acids (e.g., citrulline, homocitrulline, homoserine, norleucine, norvaline, ornithine). The amino, carboxyl and/or other functional groups on a peptide can be free (e.g., unmodified) or protected with a suitable protecting group. Suitable protecting groups for amino and carboxyl groups, and means for adding or removing protecting groups are known in the art and are disclosed in, for example, Green and Wuts, "Protecting Groups in Organic Synthesis", John Wiley and Sons, 1991. The functional groups of a peptide can also be derivatized (e.g., alkylated) using art-known methods.

In some embodiments the inhibitors or therapeutic agents provided herein include a peptidomimetic. The term "peptidomimetic", as used herein, refers to molecules which are not polypeptides, but which mimic aspects of their structures and have the same functional groups as peptides, which can inhibit TLR2 or TLR4. Peptidomimetics are designed, for example, by identifying a peptide inhibitor of TLR2 or TLR4 and modifying it using amino acid substitutes that advantageously modify the properties of the peptide, for example by increasing stability and or activity.

In some embodiments the inhibitors or therapeutic agents disclosed herein include nucleic acid molecules. As used herein, the term "nucleic acid molecule" or "nucleic acid" are used interchangeably and refer to an oligonucleotide, nucleotide or polynucleotide. Variations of "nucleic acid molecule" are described in more detail herein. A nucleic acid molecule encompasses both modified nucleic acid molecules and unmodified nucleic acid molecules as described herein. A nucleic acid molecule may include deoxyribonucleotides, ribonucleotides, modified nucleotides or nucleotide analogs in any combination.

As used herein, the term "nucleotide" refers to a chemical moiety having a sugar (or an analog thereof, or a modified sugar), a nucleotide base (or an analog thereof, or a modified base), and a phosphate group (or analog thereof, or a modified phosphate group). A nucleotide encompasses both modified nucleotides or unmodified nucleotides as described herein. As used herein, nucleotides may include deoxyribonucleotides (e.g., unmodified deoxyribonucleotides), ribonucleotides (e.g., unmodified ribonucleotides), and modified nucleotide analogs including, inter alia, locked nucleic acids and unlocked nucleic acids, peptide nucleic acids, L-nucleotides (also referred to as mirror nucleotides), ethylene-bridged nucleic acid (ENA), arabinoside, PACE, nucleotides with a 6 carbon sugar, as well as nucleotide analogs (including abasic nucleotides) often considered to be non-nucleotides. In some embodiments, nucleotides may be modified in the sugar, nucleotide base and/or in the phosphate group with any modification known in the art and/or any modification such as modifications described herein. A "polynucleotide" or "oligonucleotide" as used herein refer to a chain of linked nucleotides; polynucleotides and oligonucleotides may likewise have modifications in the nucleotide sugar, nucleotide bases and phosphate backbones as are well known in the art and/or are disclosed herein.

As used herein, the term "short interfering nucleic acid", "siNA", or "short interfering nucleic acid molecule" refers to any nucleic acid molecule capable of modulating gene expression or viral replication. Preferably siNA inhibits or down regulates gene expression or viral replication. siNA includes without limitation nucleic acid molecules that are capable of mediating sequence specific RNA interference (RNAi), for example short interfering RNA (siRNA), double-stranded NA (dsNA), double-stranded RNA (dsRNA), micro-RNA (miRNA), short hairpin RNA (shRNA), short interfering oligonucleotide, short interfering nucleic acid, short interfering modified oligonucleotide, chemically-modified siRNA, post-transcriptional gene silencing RNA (ptgsRNA), and others. As used herein, "short interfering nucleic acid", "siNA", or "short interfering nucleic acid molecule" has the meaning described in more detail elsewhere herein.

As used herein, the term "complementary" means that a nucleic acid can form hydrogen bond(s) with another nucleic acid sequence by either traditional Watson-Crick or other non-traditional types. In reference to the nucleic molecules disclosed herein, the binding free energy for a nucleic acid molecule with its complementary sequence is sufficient to allow the relevant function of the nucleic acid to proceed, e.g., RNAi activity. Determination of binding free energies for nucleic acid molecules is well known in the art (see, e.g., Turner et al., 1987, CSH Symp. Quant. Biol. LII pp. 123-133; Frier et al., 1986, Proc. Nat. Acad. Sci. USA 83:9373-9377; Turner et al., 1987, J. Am. Chem. Soc. 109:3783-3785). A percent complementarity indicates the percentage of contiguous residues in a nucleic acid molecule that can form hydrogen bonds (e.g., Watson-Crick base pairing) with a second nucleic acid sequence (e.g., 5, 6, 7, 8, 9, or 10 nucleotides out of a total of 10 nucleotides in the first oligonucleotide being based paired to a second nucleic acid sequence having 10 nucleotides represents 50%, 60%, 70%, 80%, 90%, and 100% complementary respectively). "Fully complementary" means that all the contiguous residues of a nucleic acid sequence will form hydrogen bond with the same number of contiguous residues in a second nucleic acid sequence. In one embodiment, a nucleic acid molecule disclosed herein includes about 15 to about 35 or more (e.g., about 15, 16, 17, 18, 19, 20, 21, 22, 23, 24, 25, 26, 27, 28, 29, 30, 31, 32, 33, 34 or 35 or more) nucleotides that are complementary to one or more target nucleic acid molecules or a portion thereof.

As used herein, the term "sense region" refers to a nucleotide sequence of a dsNA molecule complementary (partially or fully) to an antisense region of the dsNA molecule. The sense strand of a dsNA molecule can include a nucleic acid sequence having homology with a target nucleic acid sequence. As used herein, "sense strand" refers to nucleic acid molecule that includes a sense region and may also include additional nucleotides. The sense strand may be between 17 and 40 nucleotides in length, for instance, 17, 18, 19, 20, 21, 22, 23, 24, 25, 26, 27, 28, 29, 30, 31, 32, 33, 34, 35, 36, 37, 38, 39 or 40 nucleotides.

As used herein, the term "antisense region" refers to a nucleotide sequence of a dsNA molecule complementary (partially or fully) to a target nucleic acid sequence, preferably a target mRNA. The antisense strand of a dsNA molecule can optionally include a nucleic acid sequence complementary to a sense region of the dsNA molecule. As used herein, "antisense strand" refers to nucleic acid molecule that includes an antisense region and may also include additional nucleotides. The antisense strand may be between 17 and 40 nucleotides in length, for instance, 17, 18, 19, 20, 21, 22, 23, 24, 25, 26, 27, 28, 29, 30, 31, 32, 33, 34, 35, 36, 37, 38, 39 or 40 nucleotides.

As used herein, the term "substantially complementary" means the antisense strand includes 1, 2, 3, 4, 5, 6, 7, 8, 9 or 10 nucleotides that are not complementary to a nucleotide sequence of an oligonucleotide, such as a sense strand or a target mRNA. In some embodiments, an antisense strand may include 1, 2, or 3 nucleotides that are unpaired, i.e., do not have a corresponding complementary nucleotide in the sense strand or in a target mRNA.

As used herein, the term "RNA" refers to a molecule that includes at least one ribonucleotide residue.

As used herein, the term "duplex region" refers to the region in two complementary or substantially complementary oligonucleotides that form base pairs with one another, either by Watson-Crick base pairing or any other manner that allows for a duplex between oligonucleotide strands that are complementary or substantially complementary. For example, an oligonucleotide strand having 21 nucleotide units can base pair with another oligonucleotide of 21 nucleotide units, yet only 19 bases on each strand are complementary or substantially complementary, such that the "duplex region" consists of 19 base pairs. The remaining base pairs may, for example, exist as 5' and 3' overhangs. Further, within the duplex region, 100% complementarity is not required; substantial complementarity is allowable within a duplex region. Substantial complementarity refers to complementarity between the strands such that they are capable of annealing under biological conditions. Techniques to empirically determine if two strands are capable of annealing under biological conditions are well know in the art. Alternatively, two strands can be synthesized and added together under biological conditions to determine if they anneal to one another.

As used herein, the terms "non-pairing nucleotide analog" means a nucleotide analog which includes a non-base pairing moiety including but not limited to: 6 des amino adenosine (Nebularine), 4-Me-indole, 3-nitropyrrole, 5-nitroindole, Ds, Pa, N3-Me ribo U, N3-Me riboT, N3-Me dC, N3-Me-dT, N1-Me-dG, N1-Me-dA, N3-ethyl-dC, N3-Me dC. In some embodiments the non-base pairing nucleotide analog is a ribonucleotide. In other embodiments it is a deoxyribonucleotide.

As used herein, the term, "terminal functional group" includes without limitation a halogen, alcohol, amine, carboxylic, ester, amide, aldehyde, ketone, ether groups.

An "abasic nucleotide" or "abasic nucleotide analog" as used herein may also be often referred to herein and in the art as a pseudo-nucleotide or an unconventional moiety. While a nucleotide is a monomeric unit of nucleic acid, generally consisting of a ribose or deoxyribose sugar, a phosphate, and a base (adenine, guanine, thymine, or cytosine in DNA; adenine, guanine, uracil, or cytosine in RNA). an abasic or pseudo-nucleotide lacks a base, and thus is not strictly a nucleotide as the term is generally used in the art. Abasic deoxyribose moieties include for example, abasic deoxyribose-3'-phosphate; 1,2-dideoxy-D-ribofuranose-3-phosphate; 1,4-anhydro-2-deoxy-D-ribitol-3-phosphate. Inverted abasic deoxyribose moieties include inverted deoxyriboabasic; 3',5' inverted deoxyabasic 5'-phosphate.

The term "capping moiety" (or "z" ") as used herein includes a moiety which can be covalently linked to the 5' terminus of the sense strand ((N')y) and includes abasic ribose moiety, abasic deoxyribose moiety, modifications to abasic ribose and abasic deoxyribose moieties including 2' O alkyl modifications; inverted abasic ribose and abasic deoxyribose moieties and modifications thereof; C6-imino-Pi; a mirror nucleotide including L-DNA and L-RNA; 5' OMe nucleotide; and nucleotide analogs including 4',5'-methylene nucleotide; 1-(β-D-erythrofuranosyl)nucleotide; 4'-thio nucleotide, carbocyclic nucleotide; 5'-amino-alkyl phosphate; 1,3-diamino-2-propyl phosphate, 3-aminopropyl phosphate; 6-aminohexyl phosphate; 12-aminododecyl phosphate; hydroxypropyl phosphate; 1,5-anhydrohexitol nucleotide; alpha-nucleotide; threo-pentofuranosyl nucleotide; acyclic 3',4'-seco nucleotide; 3,4-dihydroxybutyl nucleotide; 3,5-dihydroxypentyl nucleotide, 5'-5'-inverted abasic moiety; 1,4-butanediol phosphate; 5'-amino; and bridging or non bridging methylphosphonate and 5'-mercapto moieties.

Certain capping moieties may be abasic ribose or abasic deoxyribose moieties; inverted abasic ribose or inverted abasic deoxyribose moieties; C6-amino-Pi; a mirror nucleotide including L-DNA and L-RNA. The nucleic acid molecules as disclosed herein may be synthesized using one or more inverted nucleotides, for example inverted thymidine or inverted adenine (for example see Takei, et al., 2002. JBC 277(26):23800-06).

In some embodiments of Structure (A1) and Structure (A2) at least one of Z or Z' is present and comprises at least two non-nucleotide moieties covalently attached to the strand in which it is present. In some embodiments each of Z or Z' independently includes a C3 alkyl, C3 alcohol or C3 ester moiety. In some embodiments Z' is absent and Z is present and includes a non-nucleotide C3 moiety. In some embodiments Z is absent and Z' is present and includes a non-nucleotide C3 moiety. Exemplary non-nucleotide moieties include the alkyl and modified alkyl moieties shown below:

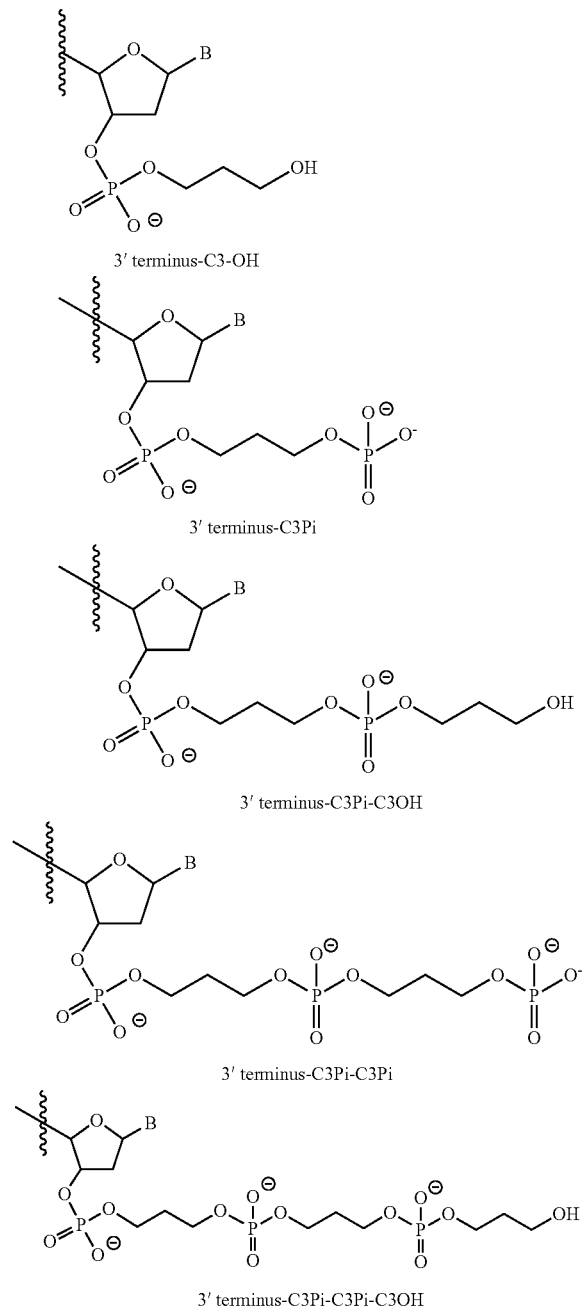

In some embodiments of Structures (A1) and (A2), each of N and N' is an unmodified nucleotide. In some embodiments at least one of N or N' includes a chemically modified nucleotide or an unconventional moiety. In some embodiments the unconventional moiety is selected from a mirror nucleotide, an abasic ribose moiety and an abasic deoxyribose moiety. In some embodiments the unconventional moiety is a mirror nucleotide, preferably an L-deoxyribonucleotide (L-DNA) moiety. In some embodiments at least one of N or N' includes a 2'-OMe sugar-modified ribonucleotide.

The term "unconventional moiety" as used herein refers to non-nucleotide moieties including an abasic moiety, an inverted abasic moiety, a hydrocarbon (alkyl) moiety and derivatives thereof, and further includes a deoxyribonucleotide, a modified deoxyribonucleotide, a mirror nucleotide (L-DNA or L-RNA), a non-base pairing nucleotide analog and a nucleotide joined to an adjacent nucleotide by a 2'-5' internucleotide phosphate bond; bridged nucleic acids including LNA and ethylene bridged nucleic acids, linkage modified (e.g. PACE) and base modified nucleotides, as well as additional moieties explicitly disclosed herein as unconventional moieties.

As used herein, the term "inhibit", "down-regulate", or "reduce" with respect to gene expression means that the expression of a target gene, or level of RNA molecules or equivalent RNA molecules encoding one or more proteins or protein subunits (e.g., mRNA), or activity of one or more proteins or protein subunits, is reduced below that observed in the absence of an inhibitory factor (such as a nucleic acid molecule, e.g., an dsNA, for example having structural features as described herein); for example the expression may be reduced to 90%, 80%, 70%, 60%, 50%, 40%, 30%, 20%, 10%, 5% or less than that observed in the absence of an inhibitor.

RNA Interference and dsNA Nucleic Acid Molecules

RNA interference refers to the process of sequence-specific post-transcriptional gene silencing in animals mediated by short interfering RNAs (siRNAs) (Zamore et al., 2000, Cell, 101, 25-33; Fire et al., 1998, Nature, 391, 806; Hamilton et al., 1999, Science, 286, 950-951; Lin et al., 1999, Nature, 402, 128-129; Sharp, 1999, Genes & Dev., 13:139-141; and Strauss, 1999, Science, 286, 886). The corresponding process in plants (Heifetz et al., International PCT Publication No. WO 99/61631) is often referred to as post-transcriptional gene silencing (PTGS) or RNA silencing. The process of post-transcriptional gene silencing is thought to be an evolutionarily-conserved cellular defense mechanism used to prevent the expression of foreign genes (Fire et al., 1999, Trends Genet., 15, 358). Such protection from foreign gene expression may have evolved in response to the production of double-stranded RNAs (dsRNAs) derived from viral infection or from the random integration of transposon elements into a host genome via a cellular response that specifically destroys homologous single-stranded RNA or viral genomic RNA. The presence of dsRNA in cells triggers the RNAi response through a mechanism that has yet to be fully characterized. This mechanism appears to be different from other known mechanisms involving double-stranded RNA-specific ribonucleases, such as the interferon response that results from dsRNA-mediated activation of protein kinase PKR and 2',5'-oligoadenylate synthetase resulting in non-specific cleavage of mRNA by ribonuclease L (see for example U.S. Pat. Nos. 6,107,094; 5,898,031; Clemens et al., 1997, J. Interferon & Cytokine Res., 17, 503-524; Adah et al., 2001, Curr. Med. Chem., 8, 1189).

The presence of long dsRNAs in cells stimulates the activity of a ribonuclease III enzyme referred to as dicer (Bass, 2000, Cell, 101, 235; Zamore et al., 2000, Cell, 101, 25-33; Hammond et al., 2000, Nature, 404, 293). Dicer is involved in the processing of the dsRNA into short pieces of dsRNA known as short interfering RNAs (siRNAs) (Zamore et al., 2000, Cell, 101, 25-33; Bass, 2000, Cell, 101, 235; Berstein et al., 2001, Nature, 409, 363). Short interfering RNAs derived from dicer activity are typically about 21 to about 23 nucleotides in length and include about 19 base pair duplexes (Zamore et al., 2000, Cell, 101, 25-33; Elbashir et al., 2001, Genes Dev., 15, 188). Dicer has also been implicated in the excision of 21- and 22-nucleotide small temporal RNAs (stRNAs) from precursor RNA of conserved structure that are implicated in translational control (Hutvagner et al., 2001, Science, 293, 834). The RNAi response also features an endonuclease complex, commonly referred to as an RNA-induced silencing complex (RISC), which mediates cleavage of single-stranded RNA having sequence complementary to the antisense strand of the siRNA duplex. Cleavage of the target RNA takes place in the middle of the region complementary to the antisense strand of the siRNA duplex (Elbashir et al., 2001, Genes Dev., 15, 188).

RNAi has been studied in a variety of systems. Fire et al., 1998, Nature, 391, 806, were the first to observe RNAi in *C. elegans*. Bahramian and Zarbl, 1999, Molecular and Cellular Biology, 19, 274-283 and Wianny and Goetz, 1999, Nature Cell Biol., 2, 70, describe RNAi mediated by dsRNA in mammalian systems. Hammond et al., 2000, Nature, 404, 293, describe RNAi in *Drosophila* cells transfected with dsRNA. Elbashir et al., 2001, Nature, 411, 494 and Tuschl et al., International PCT Publication No. WO 01/75164, describe RNAi induced by introduction of duplexes of synthetic 21-nucleotide RNAs in cultured mammalian cells including human embryonic kidney and HeLa cells. Recent work in *Drosophila* embryonic lysates (Elbashir et al., 2001, EMBO J., 20, 6877 and Tuschl et al., International PCT Publication No. WO 01/75164) has revealed certain requirements for siRNA length, structure, chemical composition, and sequence that are essential to mediate efficient RNAi activity.

Nucleic acid molecules (for example having structural features as disclosed herein) may inhibit or down regulate gene expression or viral replication by mediating RNA interference "RNAi" or gene silencing in a sequence-specific manner; see e.g., Zamore et al., 2000, Cell, 101, 25-33; Bass, 2001, Nature, 411, 428-429; Elbashir et al., 2001, Nature, 411, 494-498; and Kreutzer et al., International PCT Publication No. WO 00/44895; Zernicka-Goetz et al., International PCT Publication No. WO 01/36646; Fire, International PCT Publication No. WO 99/32619; Plaetinck et al., International PCT Publication No. WO 00/01846; Mello and Fire, International PCT Publication No. WO 01/29058; Deschamps-Depaillette, International PCT Publication No. WO 99/07409; and Li et al., International PCT Publication No. WO 00/44914; Allshire, 2002, Science, 297, 1818-1819; Volpe et al., 2002, Science, 297, 1833-1837; Jenuwein, 2002, Science, 297, 2215-2218; and Hall et al., 2002, Science, 297, 2232-2237; Hutvagner and Zamore, 2002, Science, 297, 2056-60; McManus et al., 2002, RNA, 8, 842-850; Reinhart et al., 2002, Gene & Dev., 16, 1616-1626; and Reinhart & Bartel, 2002, Science, 297, 1831).

A double-stranded nucleic acid molecule can be assembled from two separate polynucleotide strands, where one strand is the sense strand and the other is the antisense strand in which the antisense and sense strands are self-complementary (i.e. each strand includes nucleotide sequence that is complementary to nucleotide sequence in the other strand); such as where the antisense strand and sense strand form a duplex or double-stranded structure having any length and structure as described herein for nucleic acid molecules as provided, for example wherein the double-stranded region (duplex region) is about 15 to about 40 (e.g., about 17, 18, 19, 20, 21, 22, 23, 24, 25, 26, 27, 28, 29, 30, 31, 32, 33, 34, 35, 36, 37, 38, 39, or 40 base pairs); the antisense strand includes nucleotide sequence that is complementary to nucleotide sequence in a target nucleic acid molecule (i.e., TLR2 and TLR4 mRNA) or a portion thereof and the sense strand includes nucleotide sequence corresponding to the target nucleic acid sequence or a portion thereof (e.g., about 17 to about 40 nucleotides of the nucleic acid molecules herein are complementary to the target nucleic acid or a portion thereof).

In certain aspects and embodiments a nucleic acid molecule (e.g., a dsNA molecule) provided herein may be a "RISC length" molecule or may be a Dicer substrate as described in more detail below.

A dsNA nucleic acid molecule may include separate sense and antisense sequences or regions, where the sense and antisense regions are covalently linked by nucleotide or non-nucleotide linkers molecules as is known in the art, or are alternately non-covalently linked by ionic interactions, hydrogen bonding, van der Waals interactions, hydrophobic interactions, and/or stacking interactions. Nucleic acid molecules may include a nucleotide sequence that is complementary to nucleotide sequence of a target gene or of a target mRNA. Nucleic acid molecules may interact with nucleotide sequence of a target gene in a manner that causes inhibition of expression of the target gene.

Alternatively, a dsNA nucleic acid molecule is assembled from a single polynucleotide, where the self-complementary sense and antisense regions of the nucleic acid molecules are linked by means of a nucleic acid based or non-nucleic acid-based linker(s), i.e., the antisense strand and the sense strand are part of one single polynucleotide that having an antisense region and sense region that fold to form a duplex region (for example to form a "hairpin" structure as is well known in the art). Such dsNA nucleic acid molecules can be a polynucleotide with a duplex, asymmetric duplex, hairpin or asymmetric hairpin secondary structure, having self-complementary sense and antisense regions, wherein the antisense region includes nucleotide sequence that is complementary to nucleotide sequence in a separate target nucleic acid molecule (e.g. TLR2 mRNA or TLR4 mRNA) or a portion thereof and the sense region having nucleotide sequence corresponding to the target nucleic acid sequence (i.e., a sequence of TLR2 mRNA or a sequence of TLR4 mRNA). Such dsNA nucleic acid molecules can be a circular single-stranded polynucleotide having two or more loop structures and a stem comprising self-complementary sense and antisense regions, wherein the antisense region includes nucleotide sequence that is complementary to nucleotide sequence in a target nucleic acid molecule (e.g. TLR2 mRNA or TLR4 mRNA) or a portion thereof and the sense region having nucleotide sequence corresponding to the target nucleic acid sequence (e.g. TLR2 mRNA or TLR4 mRNA) or a portion thereof, and wherein the circular polynucleotide can be processed either in vivo or in vitro to generate an active nucleic acid molecule capable of mediating RNAi.

Chemical Modifications of Nucleic Acid Molecules

In certain aspects and embodiments, the methods provided herein utilizes nucleic acid therapeutic agents. The nucleic acid molecules (e.g., dsNA molecules) as provided herein include one or more modifications (or chemical modifications). Without being bound to theory, the chemical modifications confer upon the nucleic acid molecules beneficial properties including nuclease stability, reduced off-target activity and or reduced immune stimulation. In certain embodiments, such modifications include any changes to a nucleic acid molecule or polynucleotide that would make the molecule different than a standard ribonucleotide or RNA molecule (i.e., that includes standard adenine, cytosine, uracil, or guanine moieties); which may be referred to as an "unmodified" ribonucleotide or unmodified ribonucleic acid. Traditional DNA bases and polynucleotides having a 2'-deoxy sugar represented by adenine, cytosine, thymine, or guanine moieties may be referred to as an "unmodified deoxyribonucleotide" or "unmodified deoxyribonucleic acid";

accordingly, the term "unmodified nucleotide" or "unmodified nucleic acid" as used herein refers to an "unmodified ribonucleotide" or "unmodified ribonucleic acid" unless there is a clear indication to the contrary. Such modifications can be in the nucleotide sugar, nucleotide base, nucleotide phosphate group and/or the phosphate backbone of a polynucleotide.

In certain embodiments, modifications as disclosed herein, may be used to increase RNAi activity of a dsNA molecule and/or to increase the in vivo stability of the dsNA molecules, particularly the stability in serum, and/or to increase bioavailability of the dsNA molecules. Non-limiting examples of modifications include without limitation internucleotide or internucleoside linkages; deoxyribonucleotides or dideoxyribonucleotides at any position and strand of the double-stranded nucleic acid molecule; nucleic acid (e.g., ribonucleic acid) with a modification at the 2'-position preferably selected from an amino, fluoro, methoxy, alkoxy and alkyl; 2'-deoxyribonucleotides, 2'-O-methyl ribonucleotides, 2'-deoxy-2'-fluoro ribonucleotides, "universal base" nucleotides, "acyclic" nucleotides, 5-C-methyl nucleotides, biotin group, and terminal glyceryl and/or inverted deoxy abasic residue incorporation, sterically hindered molecules, such as fluorescent molecules and the like. Other nucleotides modifiers could include 3'-deoxyadenosine (cordycepin), 3'-azido-3'-deoxythymidine (AZT), 2',3'-dideoxyinosine (ddI), 2',3'-dideoxy-3'-thiacytidine (3TC), 2',3'-didehydro-2',3'-dideoxythymidine (d4T) and the monophosphate nucleotides of 3'-azido-3'-deoxythymidine (AZT), 2',3'-dideoxy-3'-thiacytidine (3TC) and 2',3'-didehydro-2',3'-dideoxythymidine (d4T). Further details on various modifications are described in more detail below.

Non-limiting examples of chemically modified nucleotides having a northern configuration include locked nucleic acid (LNA) nucleotides (e.g., 2'-O, 4'-C-methylene-(D-ribofuranosyl)nucleotides); 2'-methoxyethoxy (MOE) nucleotides; 2'-methyl-thio-ethyl, 2'-deoxy-2'-fluoro nucleotides, 2'-deoxy-2'-chloro nucleotides, 2'-azido nucleotides, and 2'-O-methyl nucleotides. Locked nucleic acids, or LNA's are described, for example, in Elman et al., 2005; Kurreck et al., 2002; Crinelli et al., 2002; Braasch and Corey, 2001; Bondensgaard et al., 2000; Wahlestedt et al., 2000; and International Patent Publication Nos. WO 00/47599, WO 99/14226, and WO 98/39352 and WO 2004/083430. In one embodiment of the therapeutic agent provided herein, an LNA is incorporated at the 5' terminus of the sense strand of the nucleic acid molecule.

Chemical modifications also include unlocked nucleic acids, or UNAs, which are non-nucleotide, acyclic analogues, in which the C2'-C3' bond is not present (although UNAs are not truly nucleotides, they are expressly included in the scope of "modified" nucleotides or modified nucleic acids as contemplated herein). Exemplary UNAs are disclosed in Nucleic Acids Symposium Series No. 52 p. 133-134 (2008). In certain embodiments a nucleic acid molecule (e.g., a siNA molecule) as described herein include one or more UNAs; or one UNA. In some embodiments, a nucleic acid molecule (e.g., a siNA molecule) as described herein has a 3'-overhang that includes one or two UNAs in the 3' overhang. In some embodiments a nucleic acid molecule (e.g., a siNA molecule) as described herein includes a UNA (for example one UNA) in the antisense strand; for example in position 6 or position 7 of the antisense strand.

Chemical modifications also include non-pairing nucleotide analogs, for example as disclosed herein. Chemical modifications further include unconventional moieties as disclosed herein.

Chemical modifications also include terminal modifications on the 5' and/or 3' part of the oligonucleotides and are also known as capping moieties. Such terminal modifications are selected from a nucleotide, a modified nucleotide, a lipid, a peptide, and a sugar, an abasic ribose moiety and an abasic deoxyribose moiety.

Chemical modifications also include six membered "six membered ring nucleotide analogs." Examples of six-membered ring nucleotide analogs are disclosed in Allart, et al (Nucleosides & Nucleotides, 1998, 17:1523-1526; and Perez-Perez, et al., 1996, Bioorg. and Medicinal Chem Letters 6:1457-1460) Oligonucleotides including 6-membered ring nucleotide analogs including hexitol and altritol nucleotide monomers are disclosed in International patent application publication No. WO 2006/047842.

Chemical modifications also include "mirror" nucleotides which have a reversed chirality as compared to normal naturally occurring nucleotide; that is a mirror nucleotide may be an "L-nucleotide" analogue of naturally occurring D-nucleotide (see U.S. Pat. No. 6,602,858). Mirror nucleotides may further include at least one sugar or base modification and/or a backbone modification, for example, as described herein, such as a phosphorothioate or phosphonate moiety. U.S. Pat. No. 6,602,858 discloses nucleic acid catalysts including at least one L-nucleotide substitution. Mirror nucleotides include for example L-DNA (L-deoxyriboadenosine-3'-phosphate (mirror dA); L-deoxyribocytidine-3'-phosphate (mirror dC); L-deoxyriboguanosine-3'-phosphate (mirror dG); L-deoxyribothymidine-3'-phosphate (mirror image dT)) and L-RNA (L-riboadenosine-3'-phosphate (mirror rA); L-ribocytidine-3'-phosphate (mirror rC); L-riboguanosine-3'-phosphate (mirror rG); L-ribouracil-3'-phosphate (mirror dU).

In some embodiments, modified ribonucleotides include modified deoxyribonucleotides, for example 5'OMe DNA (5-methyl-deoxyriboguanosine-3'-phosphate) which may be useful as a nucleotide in the 5' terminal position (position number 1); PACE (deoxyriboadenine 3' phosphonoacetate, deoxyribocytidine 3' phosphonoacetate, deoxyriboguanosine 3' phosphonoacetate, deoxyribothymidine 3' phosphonoacetate.

Modifications may be present in one or more strands of a nucleic acid molecule disclosed herein, e.g., in the sense strand, the antisense strand, or both strands. In certain embodiments, the antisense strand may include modifications and the sense strand my only include unmodified ribonucleotides.

Nucleobases

Nucleobases of the nucleic acid disclosed herein may include unmodified ribonucleotides (purines and pyrimidines) such as adenine, guanine, cytosine, uridine. The nucleobases in one or both strands can be modified with natural and synthetic nucleobases such as, thymine, xanthine, hypoxanthine, ionosine, 2-aminoadenine, 6-methyl and other alkyl derivatives of adenine and guanine, any "universal base" nucleotides; 2-propyl and other alkyl derivatives of adenine and guanine, 5-halouracil and cytosine, 5-propynyl uracil and cytosine, 6-azo uracil, cytosine and thymine, 5-uracil (pseudouracil), 4-thiouracil, 8-halo, amino, thiol, thioalkyl, hydroxyl and other 8-substituted adenines and guanines, 5-trifluoromethyl and other 5-substituted uracils and cytosines, 7-methylguanine, deazapurines, heterocyclic substituted analogs of purines and pyrimidines, e.g., aminoethyoxy phenoxazine, derivatives of purines and pyrimidines (e.g., 1-alkyl-, 1-alkenyl-, heteroaromatic- and 1-alkynyl derivatives) and tautomers thereof, 8-oxo-$N^6$-methyladenine, 7-diazaxanthine, 5-methylcytosine, 5-methyluracil, 5-(1- propynyl)uracil, 5-(1-propynyl) cytosine and 4,4-ethanocytosine). Other examples of suitable bases include non-purinyl and non-pyrimidinyl bases such as 2-aminopyridine and triazines.

Sugar Moieties

Sugar moieties in nucleic acid disclosed herein may include 2'-hydroxyl-pentofuranosyl sugar moiety without any modification. Alternatively, sugar moieties can be modified such as, 2'-deoxy-pentofuranosyl sugar moiety, D-ribose, hexose, modification at the 2' position of the pentofuranosyl sugar moiety such as 2'-O-alkyl (including 2'-O-methyl and 2'-O-ethyl), i.e., 2'-alkoxy, 2'-amino, 2'-O-allyl, 2'-S-alkyl, 2'-halogen (including 2'-fluoro, chloro, and bromo), 2'-methoxyethoxy, 2'-O-methoxyethyl, 2'-O-2-methoxyethyl, 2'-allyloxy (—OCH$_2$CH=CH$_2$), 2'-propargyl, 2'-propyl, ethynyl, ethenyl, propenyl, CF, cyano, imidazole, carboxylate, thioate, C$_1$ to C$_{10}$ lower alkyl, substituted lower alkyl, alkaryl or aralkyl, OCF$_3$, OCN, O—, S—, or N-alkyl; O—, S, or N-alkenyl; SOCH$_3$; SO$_2$CH$_3$; ONO$_2$; NO$_2$, N$_3$; heterozycloalkyl; heterozycloalkaryl; aminoalkylamino; polyalkylamino or substituted silyl, as, among others, for example as described in European patents EP 0 586 520 B1 or EP 0 618 925 B1.

Alkyl group includes saturated aliphatic groups, including straight-chain alkyl groups (e.g., methyl, ethyl, propyl, butyl, pentyl, hexyl, heptyl, octyl, nonyl, decyl, etc.), branched-chain alkyl groups (isopropyl, tert-butyl, isobutyl, etc.), cycloalkyl (alicyclic) groups (cyclopropyl, cyclopentyl, cyclohexyl, cycloheptyl, cyclooctyl), alkyl substituted cycloalkyl groups, and cycloalkyl substituted alkyl groups. In certain embodiments, a straight chain or branched chain alkyl has 6 or fewer carbon atoms in its backbone (e.g., C$_1$-C$_6$ for straight chain, C$_3$-C$_6$ for branched chain), and more preferably 4 or fewer. Likewise, preferred cycloalkyls may have from 3-8 carbon atoms in their ring structure, and more preferably have 5 or 6 carbons in the ring structure. The term C$_1$-C$_6$ includes alkyl groups containing 1 to 6 carbon atoms. The alkyl group can be substituted alkyl group such as alkyl moieties having substituents replacing a hydrogen on one or more carbons of the hydrocarbon backbone. Such substituents can include, for example, alkenyl, alkynyl, halogen, hydroxyl, alkylcarbonyloxy, arylcarbonyloxy, alkoxycarbonyloxy, aryloxycarbonyloxy, carboxylate, alkylcarbonyl, arylcarbonyl, alkoxycarbonyl, aminocarbonyl, alkylaminocarbonyl, dialkylaminocarbonyl, alkylthiocarbonyl, alkoxyl, phosphate, phosphonato, phosphinato, cyano, amino (including alkyl amino, dialkylamino, arylamino, diarylamino, and alkylarylamino), acylamino (including alkylcarbonylamino, arylcarbonylamino, carbamoyl and ureido), amidino, imino, sulfhydryl, alkylthio, arylthio, thiocarboxylate, sulfates, alkylsulfinyl, sulfonato, sulfamoyl, sulfonamido, nitro, trifluoromethyl, cyano, azido, heterocyclyl, alkylaryl, or an aromatic or heteroaromatic moiety.

Alkoxy group includes substituted and unsubstituted alkyl, alkenyl, and alkynyl groups covalently linked to an oxygen atom. Examples of alkoxy groups include methoxy, ethoxy, isopropyloxy, propoxy, butoxy, and pentoxy groups. Examples of substituted alkoxy groups include halogenated alkoxy groups. The alkoxy groups can be substituted with groups such as alkenyl, alkynyl, halogen, hydroxyl, alkylcarbonyloxy, arylcarbonyloxy, alkoxycarbonyloxy, aryloxycarbonyloxy, carboxylate, alkylcarbonyl, arylcarbonyl, alkoxycarbonyl, aminocarbonyl, alkylaminocarbonyl, dialkylaminocarbonyl, alkylthiocarbonyl, alkoxyl, phosphate, phosphonato, phosphinato, cyano, amino (including alkyl amino, dialkylamino, arylamino, diarylamino, and alkylarylamino), acylamino (including alkylcarbonylamino, arylcarbonylamino, carbamoyl and ureido), amidino, imino, sulfhydryl, alkylthio, arylthio, thiocarboxylate, sulfates, alkylsulfinyl, sulfonato, sulfamoyl, sulfonamido, nitro, trifluoromethyl, cyano, azido, heterocyclyl, alkylaryl, or an aromatic or heteroaromatic moieties. Examples of halogen substituted alkoxy groups include, but are not limited to, fluoromethoxy, difluoromethoxy, trifluoromethoxy, chloromethoxy, dichloromethoxy, trichloromethoxy, etc.

In some embodiments, the pentafuronosyl ring may be replaced with acyclic derivatives lacking the C2'-C3'-bond of the pentafuronosyl ring. For example, acyclonucleotides may substitute a 2-hydroxyethoxymethyl group for the 2'-deoxyribofuranosyl sugar normally present in dNMPs.

Halogens include fluorine, bromine, chlorine, iodine.

Backbone

The nucleoside subunits of the nucleic acid disclosed herein may be linked to each other by phosphodiester bond. The phosphodiester bond may be optionally substituted with other linkages. For example, phosphorothioate, thiophosphate-D-ribose entities, triester, thioate, 2'-5' bridged backbone (may also be referred to as 5'-2'), PACE, 3'-(or -5') deoxy-3'-(or -5')thio-phosphorothioate, phosphorodithioate, phosphoroselenates, 3'-(or -5')deoxy phosphinates, borano phosphates, 3'-(or -5')deoxy-3'-(or -5')amino phosphoramidates, hydrogen phosphonates, phosphonates, borano phosphate esters, phosphoramidates, alkyl or aryl phosphonates and phosphotriester modifications such as alkylphosphotriesters, phosphotriester phosphorus linkages, 5'-ethoxyphosphodiester, P-alkyloxyphosphotriester, methylphosphonate, and nonphosphorus containing linkages for example, carbonate, carbamate, silyl, sulfur, sulfonate, sulfonamide, formacetal, thioformacetyl, oxime, methyleneimino, methylenemethylimino, methylenehydrazo, methylenedimethylhydrazo and methyleneoxymethylimino linkages.

Nucleic acid molecules disclosed herein may include a peptide nucleic acid (PNA) backbone. The PNA backbone includes repeating N-(2-aminoethyl)-glycine units linked by peptide bonds. The various bases such as purine, pyrimidine, natural and synthetic bases are linked to the backbone by methylene carbonyl bonds.

Terminal Phosphates

Modifications can be made at terminal phosphate goups. Non-limiting examples of different stabilization chemistries can be used, e.g., to stabilize the 3'-end of nucleic acid sequences, including (1) [3-3']-inverted deoxyribose; (2) deoxyribonucleotide; (3) [5'-3']-3'-deoxyribonucleotide; (4) [5'-3']-ribonucleotide; (5) [5'-3']-3'-O-methyl ribonucleotide; (6) 3'-glyceryl; (7) [3-5']-3'-deoxyribonucleotide; (8) [3'-3']-deoxyribonucleotide; (9) [5'-2']-deoxyribonucleotide; and (10) [5-3']-dideoxyribonucleotide. Exemplary chemically modified terminal phosphate groups include those shown below:

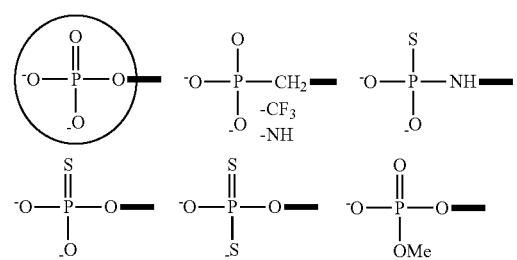

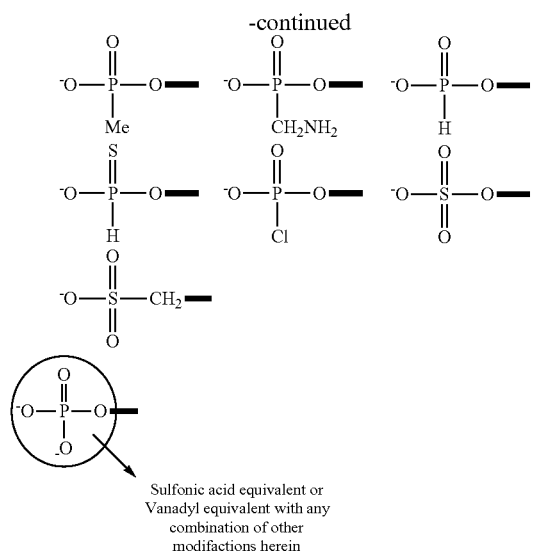

Sulfonic acid equivalent or Vanadyl equivalent with any combination of other modifactions herein Conjugates Modified nucleotides and nucleic acid molecules (e.g., dsNA molecules) as provided herein may include conjugates, for example, a conjugate covalently attached to the chemically-modified nucleic acid molecule. Non-limiting examples of conjugates include conjugates and ligands described in Vargeese et al., U.S. Ser. No. 10/427,160. The conjugate may be covalently attached to a nucleic acid molecule (such as an siNA molecule) via a biodegradable linker. The conjugate molecule may be attached at the 3'-end of either the sense strand, the antisense strand, or both strands of the chemically-modified nucleic acid molecule. The conjugate molecule may be attached at the 5'-end of either the sense strand, the antisense strand, or both strands of the chemically-modified nucleic acid molecule. The conjugate molecule may be attached both the 3'-end and 5'-end of either the sense strand, the antisense strand, or both strands of the chemically-modified nucleic acid molecule, or any combination thereof. In one embodiment, a conjugate molecule may include a molecule that facilitates delivery of a chemically-modified nucleic acid molecule into a biological system, such as a cell. In another embodiment, the conjugate molecule attached to the chemically-modified nucleic acid molecule is a polyethylene glycol, human serum albumin, or a ligand for a cellular receptor that can mediate cellular uptake. Examples of specific conjugate molecules contemplated herein that can be attached to chemically-modified nucleic acid molecules are described in Vargeese et al., U.S. Ser. No. 10/201,394.

Linkers

A nucleic acid molecule provided herein (e.g., an dsNA) molecule may include a nucleotide, non-nucleotide, or mixed nucleotide/non-nucleotide linker that joins the sense region of the nucleic acid to the antisense region of the nucleic acid. A nucleotide linker can be a linker of ≥2 nucleotides in length, for example about 2, 3, 4, 5, 6, 7, 8, 9, or nucleotides in length. The nucleotide linker can be a nucleic acid aptamer. The term "aptamer" or "nucleic acid aptamer" as used herein refers to a nucleic acid molecule that binds specifically to a target molecule wherein the nucleic acid molecule has sequence that includes a sequence recognized by the target molecule in its natural setting. Alternately, an aptamer can be a nucleic acid molecule that binds to a target molecule (such as TLR2 mRNA and TLR4 mRNA) where the target molecule does not naturally bind to a nucleic acid. For example, the aptamer can be used to bind to a ligand-binding domain of a protein, thereby preventing interaction of the naturally occurring ligand with the protein. This is a non-limiting example and those in the art will recognize that other embodiments can be readily generated using techniques generally known in the art. See e.g., Gold et al.; 1995, Annu Rev. Biochem., 64, 763; Brody and Gold, 2000, J. Biotechnol., 74, 5; Sun, 2000, Curr. Opin. Mol. Ther., 2, 100; Kusser, 2000, J. Biotechnol., 74, 27; Hermann and Patel, 2000, Science, 287, 820; and Jayasena, 1999, Clinical Chemistry, 45, 1628.

A non-nucleotide linker may include an abasic nucleotide, polyether, polyamine, polyamide, peptide, carbohydrate, lipid, polyhydrocarbon, or other polymeric compounds (e.g. polyethylene glycols such as those having between 2 and 100 ethylene glycol units). Specific examples include those described by Seela and Kaiser, Nucleic Acids Res. 1990, 18:6353 and Nucleic Acids Res. 1987, 15:3113; Cload and Schepartz, J. Am. Chem. Soc. 1991, 113:6324; Richardson and Schepartz, J. Am. Chem. Soc. 1991, 113:5109; Ma et al., Nucleic Acids Res. 1993, 21:2585 and Biochemistry 1993, 32:1751; Durand et al., Nucleic Acids Res. 1990, 18:6353; McCurdy et al., Nucleosides & Nucleotides 1991, 10:287; Jschke et al., Tetrahedron Lett. 1993, 34:301; Ono et al., Biochemistry 1991, 30:9914; Arnold et al., International Publication No. WO 89/02439; Usman et al., International Publication No. WO 95/06731; Dudycz et al., International Publication No. WO 95/11910 and Ferentz and Verdine, J. Am. Chem. Soc. 1991, 113:4000.

5' Ends, 3' Ends and Overhangs

Nucleic acid molecules disclosed herein (e.g., dsNA molecules) may be blunt-ended on both sides, have overhangs on both ends or a combination of blunt and overhang ends. Overhangs may occur on either the 5'- or 3'-end of the sense or antisense strand.

5'- and/or 3'-ends of double-stranded nucleic acid molecules (e.g., dsNA) may be blunt ended or have an overhang. The 5'-end may be blunt ended and the 3'-end has an overhang in either the sense strand or the antisense strand. In other embodiments, the 3'-end may be blunt ended and the 5'-end has an overhang in either the sense strand or the antisense strand. In yet other embodiments, both the 5'- and 3'-end are blunt ended or both the 5'- and 3'-ends have overhangs.

The 5'- and/or 3'-end of one or both strands of the nucleic acid may include a free hydroxyl group. The 5'- and/or 3'-end of any nucleic acid molecule strand may be modified to include a chemical modification. Such modification may stabilize nucleic acid molecules, e.g., the 3'-end may have increased stability due to the presence of the nucleic acid molecule modification. Examples of end modifications (e.g., terminal caps) include, but are not limited to, abasic, deoxy abasic, inverted (deoxy) abasic, glyceryl, dinucleotide, acyclic nucleotide, amino, fluoro, chloro, bromo, CN, CF, methoxy, imidazole, carboxylate, thioate, $C_1$ to $C_{10}$ lower alkyl, substituted lower alkyl, alkaryl or aralkyl, $OCF_3$, OCN, O—, S—, or N-alkyl; O—, S—, or N-alkenyl; $SOCH_3$; $SO_2CH_3$; $ONO_2$; $NO_2$, $N_3$; heterocycloalkyl; heterocycloalkaryl; aminoalkylamino; polyalkylamino or substituted silyl, as, among others, described in European patents EP 586,520 and EP 618,925 and other modifications disclosed herein.

Nucleic acid molecules include those with blunt ends, i.e., ends that do not include any overhanging nucleotides. A nucleic acid molecule can include one or more blunt ends. The blunt ended nucleic acid molecule has a number of base pairs equal to the number of nucleotides present in each strand of the nucleic acid molecule. The nucleic acid molecule can include one blunt end, for example where the 5'-end of the antisense strand and the 3'-end of the sense strand do not have any overhanging nucleotides. Nucleic acid molecule may include one blunt end, for example where the 3'-end of the antisense strand and the 5'-end of the sense strand do not have any overhanging nucleotides. A nucleic acid molecule may include two blunt ends, for example where the 3'-end of the antisense strand and the 5'-end of the sense strand as well as the 5'-end of the antisense strand and 3'-end of the sense strand do not have any overhanging nucleotides. Other nucleotides present in a blunt ended nucleic acid molecule can include, for example, mismatches, bulges, loops, or wobble base pairs to modulate the activity of the nucleic acid molecule, e.g. to mediate RNA interference.

In certain embodiments of the nucleic acid molecules (e.g., dsNA molecules) provided herein, at least one end of the molecule has an overhang of at least one nucleotide (for example 1 to 8 overhang nucleotides). For example, one or both strands of a double-stranded nucleic acid molecule disclosed herein may have an overhang at the 5'-end or at the 3'-end or both. An overhang may be present at either or both the sense strand and antisense strand of the nucleic acid molecule. The length of the overhang may be as little as one nucleotide and as long as 1 to 8 or more nucleotides (e.g., 1, 2, 3, 4, 5, 6, 7 or 8 nucleotides; in some preferred embodiments an overhang is 2, 3, 4, 5, 6, 7 or 8 nucleotides; for example an overhang may be 2 nucleotides. The nucleotide(s) forming the overhang may be include deoxyribonucleotide(s), ribonucleotide(s), natural and non-natural nucleobases or any nucleotide modified in the sugar, base or phosphate group, such as disclosed herein. A double-stranded nucleic acid molecule may have both 5'- and 3'-overhangs. The overhangs at the 5'- and 3'-end may be of different lengths. A overhang may include at least one nucleic acid modification which may be deoxyribonucleotide. One or more deoxyribonucleotides may be at the 5'-terminus. The 3'-end of the respective counter-strand of the nucleic acid molecule may not have an overhang, more preferably not a deoxyribonucleotide overhang. The one or more deoxyribonucleotide may be at the 3'-terminus. The 5'-end of the respective counter-strand of the dsRNA may not have an overhang, more preferably not a deoxyribonucleotide overhang. The overhang in either the 5'- or the 3'-end of a strand may be 1 to 8 (e.g., about 1, 2, 3, 4, 5, 6, 7 or 8) unpaired nucleotides, preferably, the overhang is 2-3 unpaired nucleotides; more preferably 2 unpaired nucleotides. Nucleic acid molecules may include duplex nucleic acid molecules with overhanging ends of about 1 to about 20 (e.g., about 1, 2, 3, 4, 5, 6, 7, 8, 9, 10, 11, 12, 13, 1, 15, 16, 17, 18, 19 or 20); preferably 1-8 (e.g., about 1, 2, 3, 4, 5, 6, 7 or 8) nucleotides, for example, about 21-nucleotide duplexes with about 19 base pairs and 3'-terminal mononucleotide, dinucleotide, or trinucleotide overhangs. Nucleic acid molecules provided herein may include duplex nucleic acid molecules with blunt ends, where both ends are blunt, or alternatively, where one of the ends is blunt. Nucleic acid molecules disclosed herein can include one or more blunt ends, i.e. where a blunt end does not have any overhanging nucleotides. In one embodiment, the blunt ended nucleic acid molecule has a number of base pairs equal to the number of nucleotides present in each strand of the nucleic acid molecule. The nucleic acid molecule may include one blunt end, for example where the 5'-end of the antisense strand and the 3'-end of the sense strand do not have any overhanging nucleotides. The nucleic acid molecule may include one blunt end, for example where the 3'-end of the antisense strand and the 5'-end of the sense strand do not have any overhanging nucleotides. A nucleic acid molecule may include two blunt ends, for example where the 3'-end of the antisense strand and the 5'-end of the sense strand as well as the 5'-end of the antisense strand and 3'-end of the sense strand do not have any overhanging nucleotides. In certain preferred embodiments the nucleic acid compounds are blunt ended. Other nucleotides present in a blunt ended dsNA molecule can include, for example, mismatches, bulges, loops, or wobble base pairs to modulate the activity of the nucleic acid molecule to mediate RNA interference.

In many embodiments one or more, or all, of the overhang nucleotides of a nucleic acid molecule (e.g., a dsNA molecule) as described herein includes are modified such as described herein; for example one or more, or all, of the nucleotides may be 2'-deoxynucleotides.

Amount, Location and Patterns of Modifications of Nucleic Acid Compounds

Nucleic acid molecules (e.g., dsNA molecules) disclosed herein may include modified nucleotides as a percentage of the total number of nucleotides present in the nucleic acid molecule. As such, a nucleic acid molecule may include about 5% to about 100% modified nucleotides (e.g., about 5%, 10%, 15%, 20%, 25%, 30%, 35%, 40%, 45%, 50%, 55%, 60%, 65%, 70%, 75%, 80%, 85%, 90%, 95% or 100% modified nucleotides). The actual percentage of modified nucleotides present in a given nucleic acid molecule will depend on the total number of nucleotides present in the nucleic acid. If the nucleic acid molecule is single stranded, the percent modification can be based upon the total number of nucleotides present in the single stranded nucleic acid molecule. Likewise, if the nucleic acid molecule is double-stranded, the percent modification can be based upon the total number of nucleotides present in the sense strand, antisense strand, or both the sense and antisense strands.

Nucleic acid molecules disclosed herein may include unmodified RNA as a percentage of the total nucleotides in the nucleic acid molecule. As such, a nucleic acid molecule may include about 5% to about 100% unmodified nucleotides (e.g., about 5%, 10%, 15%, 20%, 25%, 30%, 35%, 40%, 45%, 50%, 55%, 60%, 65%, 70%, 75%, 80%, 85%, 90%, 95% or 100% of total nucleotides present in a nucleic acid molecule).

A nucleic acid molecule (e.g., an dsNA molecule) may include a sense strand that includes about 1 to about 5, specifically about 1, 2, 3, 4, or 5 phosphorothioate internucleotide linkages, and/or one or more (e.g., about 1, 2, 3, 4, 5, or more) 2'-deoxy, 2'-O-methyl, 2'-deoxy-2'-fluoro, and/or one or more (e.g., about 1, 2, 3, 4, 5, or more) universal base modified nucleotides, and optionally a terminal cap molecule at the 3-end, the 5'-end, or both of the 3'- and 5'-ends of the sense strand; and wherein the antisense strand includes about 1 to about 5 or more, specifically about 1, 2, 3, 4, 5, or more phosphorothioate internucleotide linkages, and/or one or more (e.g., about 1, 2, 3, 4, 5, 6, 7, 8, 9, 10 or more) 2'-deoxy, 2'-O-methyl, 2'-deoxy-2'-fluoro, and/or one or more (e.g., about 1, 2, 3, 4, 5, 6, 7, 8, 9, 10 or more) universal base modified nucleotides, and optionally a terminal cap molecule at the 3'-end, the 5'-end, or both of the 3'- and 5'-ends of the antisense strand. A nucleic acid molecule may include about 1, 2, 3, 4, 5, 6, 7, 8, 9, 10, or more, pyrimidine nucleotides of the sense and/or antisense nucleic acid strand are chemically-modified with 2'-deoxy, 2'-O-methyl and/or 2'-deoxy-2'-fluoro nucleotides, with or without about 1 to about 5 or more, for example about 1, 2, 3, 4, 5, or more phosphorothioate internucleotide linkages and/or a terminal cap molecule at the 3'-end, the 5'-end, or both of the 3'- and 5'-ends, being present in the same or different strand.

A nucleic acid molecule may include about 1 to about 5 or more (specifically about 1, 2, 3, 4, 5 or more) phosphorothioate internucleotide linkages in each strand of the nucleic acid molecule.

A nucleic acid molecule may include 2'-5' internucleotide linkages, for example at the 3'-end, the 5'-end, or both of the 3'-end and 5'-end of one or both nucleic acid sequence strands. In addition, the 2'-5' internucleotide linkage(s) can be present at various other positions within one or both nucleic acid sequence strands, for example, about 1, 2, 3, 4, 5, 6, 7, 8, 9, 10, or more including every internucleotide linkage of a pyrimidine nucleotide in one or both strands of the siNA molecule can include a 2'-5' internucleotide linkage, or about 1, 2, 3, 4, 5, 6, 7, 8, 9, 10, or more including every internucleotide linkage of a purine nucleotide in one or both strands of the siNA molecule can include a 2'-5' internucleotide linkage.

A chemically-modified short interfering nucleic acid (dsNA) molecule may include an antisense region, wherein any (e.g., one or more or all) pyrimidine nucleotides present in the antisense region are 2'-deoxy-2'-fluoro pyrimidine nucleotides (e.g., wherein all pyrimidine nucleotides are 2'-deoxy-2'-fluoro pyrimidine nucleotides or alternately a plurality of pyrimidine nucleotides are 2'-deoxy-2'-fluoro pyrimidine nucleotides), and wherein any (e.g., one or more or all) purine nucleotides present in the antisense region are 2'-deoxy purine nucleotides (e.g., wherein all purine nucleotides are 2'-deoxy purine nucleotides or alternately a plurality of purine nucleotides are 2'-deoxy purine nucleotides).

A chemically-modified short interfering nucleic acid (dsNA) molecule may include an antisense region, wherein any (e.g., one or more or all) pyrimidine nucleotides present in the antisense region are 2'-deoxy-2'-fluoro pyrimidine nucleotides (e.g., wherein all pyrimidine nucleotides are 2'-deoxy-2'-fluoro pyrimidine nucleotides or alternately a plurality of pyrimidine nucleotides are 2'-deoxy-2'-fluoro pyrimidine nucleotides), and wherein any (e.g., one or more or all) purine nucleotides present in the antisense region are 2'-O-methyl purine nucleotides (e.g., wherein all purine nucleotides are 2'-O-methyl purine nucleotides or alternately a plurality of purine nucleotides are 2'-O-methyl purine nucleotides).

A chemically-modified short interfering nucleic acid (dsNA) molecule capable of mediating RNA interference (RNAi) against TLR2 and/or TLR4 inside a cell or reconstituted in vitro system may include a sense region, wherein one or more pyrimidine nucleotides present in the sense region are 2'-deoxy-2'-fluoro pyrimidine nucleotides (e.g., wherein all pyrimidine nucleotides are 2'-deoxy-2'-fluoro pyrimidine nucleotides or alternately a plurality of pyrimidine nucleotides are 2'-deoxy-2'-fluoro pyrimidine nucleotides), and one or more purine nucleotides present in the sense region are 2'-deoxy purine nucleotides (e.g., wherein all purine nucleotides are 2'-deoxy purine nucleotides or alternately a plurality of purine nucleotides are 2'-deoxy purine nucleotides), and an antisense region, wherein one or more pyrimidine nucleotides present in the antisense region are 2'-deoxy-2'-fluoro pyrimidine nucleotides (e.g., wherein all pyrimidine nucleotides are 2'-deoxy-2'-fluoro pyrimidine nucleotides or alternately a plurality of pyrimidine nucleotides are 2'-deoxy-2'-fluoro pyrimidine nucleotides), and one or more purine nucleotides present in the antisense region are 2'-O-methyl purine nucleotides (e.g., wherein all purine nucleotides are 2'-O-methyl purine nucleotides or alternately a plurality of purine nucleotides are 2'-O-methyl purine nucleotides). The sense region and/or the antisense region can have a terminal cap modification, such as any modification, that is optionally present at the 3'-end, the 5'-end, or both of the 3'-end and the 5'-end of the sense and/or antisense sequence. The sense and/or antisense region can optionally further include a 3'-terminal nucleotide overhang having about 1 to about 4 (e.g., about 1, 2, 3, or 4) 2'-deoxyribonucleotides. The overhang nucleotides can further include one or more (e.g., about 1, 2, 3, 4 or more) phosphorothioate, phosphonoacetate, and/or thiophosphonoacetate internucleotide linkages. The purine nucleotides in the sense region may alternatively be 2'-O-methyl purine nucleotides (e.g., wherein all purine nucleotides are 2'-O-methyl purine nucleotides or alternately a plurality of purine nucleotides are 2'-O-methyl purine nucleotides) and one or more purine nucleotides present in the antisense region are 2-O-methyl purine nucleotides (e.g., wherein all purine nucleotides are 2'-O-methyl purine nucleotides or alternately a plurality of purine nucleotides are 2'-O-methyl purine nucleotides). One or more purine nucleotides in the sense region may alternatively be purine ribonucleotides (e.g., wherein all purine nucleotides are purine ribonucleotides or alternately a plurality of purine nucleotides are purine ribonucleotides) and any purine nucleotides present in the antisense region are 2'-O-methyl purine nucleotides (e.g., wherein all purine nucleotides are 2'-O-methyl purine nucleotides or alternately a plurality of purine nucleotides are 2'-O-methyl purine nucleotides). One or more purine nucleotides in the sense region and/or present in the antisense region may alternatively be selected from the group consisting of 2'-deoxy nucleotides, locked nucleic acid (LNA) nucleotides, 2'-methoxyethyl nucleotides, 4'-thionucleotides, and 2'-O-methyl nucleotides (e.g., wherein all purine nucleotides are selected from the group consisting of 2'-deoxy nucleotides, locked nucleic acid (LNA) nucleotides, 2'-methoxyethyl nucleotides, 4'-thionucleotides, and 2'-O-methyl nucleotides or alternately a plurality of purine nucleotides are selected from the group consisting of 2'-deoxy nucleotides, locked nucleic acid (LNA) nucleotides, 2'-methoxyethyl nucleotides, 4'-thionucleotides, and 2'-O-methyl nucleotides).

In some embodiments, a nucleic acid molecule (e.g., a dsNA molecule) as described herein includes a modified nucleotide (for example one modified nucleotide) in the antisense strand; for example in position 6 or position 7 of the antisense strand.

Modification Patterns and Alternating Modifications of Nucleic Acid Compounds

Nucleic acid molecules (e.g., dsNA molecules) provided herein may have patterns of modified and unmodified nucleic acids. A pattern of modification of the nucleotides in a contiguous stretch of nucleotides may be a modification contained within a single nucleotide or group of nucleotides that are covalently linked to each other via standard phosphodiester bonds or, at least partially, through phosphorothioate bonds. Accordingly, a "pattern" as contemplated herein, does not necessarily need to involve repeating units, although it may. Examples of modification patterns that may be used in conjunction with the nucleic acid molecules (e.g., dsNA molecules) provided herein include those disclosed in Giese, U.S. Pat. No. 7,452,987. For example, nucleic acid molecules (e.g., dsNA molecules) provided herein include those having modification patterns such as, similar to, or the same as, the patterns shown diagrammatically in FIG. 2 of the Giese U.S. Pat. No. 7,452,987.

A modified nucleotide or group of modified nucleotides may be at the 5'-end or the 3'-end of the sense strand or the antisense strand, a flanking nucleotide or group of nucleotides is arrayed on both sides of the modified nucleotide or group, where the flanking nucleotide or group either is unmodified or does not have the same modification of the preceding nucleotide or group of nucleotides. The flanking nucleotide or group of nucleotides may, however, have a different modification. This sequence of modified nucleotide or group of modified nucleotides, respectively, and unmodified or differently modified nucleotide or group of unmodified or differently modified nucleotides may be repeated one or more times.

In some patterns, the 5'-terminal nucleotide of a strand is a modified nucleotide while in other patterns the 5'-terminal nucleotide of a strand is an unmodified nucleotide. In some patterns, the 5'-end of a strand starts with a group of modified nucleotides while in other patterns, the 5'-terminal end is an unmodified group of nucleotides. This pattern may be either on the first stretch or the second stretch of the nucleic acid molecule or on both.

Modified nucleotides of one strand of the nucleic acid molecule may be complementary in position to the modified or unmodified nucleotides or groups of nucleotides of the other strand.

There may be a phase shift between modifications or patterns of modifications on one strand relative to the pattern of modification of the other strand such that the modification groups do not overlap. In one instance, the shift is such that the modified group of nucleotides of the sense strand corresponds to the unmodified group of nucleotides of the antisense strand and vice versa.

There may be a partial shift of the pattern of modification such that the modified groups overlap. The groups of modified nucleotides in any given strand may optionally be the same length, but may be of different lengths. Similarly, groups of unmodified nucleotides in any given strand may optionally be the same length, or of different lengths.

In some patterns, the second (penultimate) nucleotide at the terminus of the strand, is an unmodified nucleotide or the beginning of group of unmodified nucleotides. Preferably, this unmodified nucleotide or unmodified group of nucleotides is located at the 5'-end of the either or both the sense strand and the antisense strand and even more preferably at the terminus of the sense strand. An unmodified nucleotide or unmodified group of nucleotide may be located at the 5'-end of the sense strand. In one embodiment the pattern consists of alternating single modified and unmodified nucleotides.

In some double-stranded nucleic acid molecules a 2'-O-methyl modified nucleotide and a non-modified nucleotide or a nucleotide which is not 2'-O-methyl modified, are incorporated on both strands in an alternating fashion, resulting in a pattern of alternating 2'-O-methyl modified nucleotides and nucleotides that are either unmodified or at least do not include a 2'-O-methyl modification. In certain embodiments, the same sequence of 2'-O-methyl modification and non-modification exists on the second strand; in other embodiments the alternating 2'-O-methyl modified nucleotides are only present in the sense strand and are not present in the antisense strand; and in yet other embodiments the alternating 2'-O-methyl modified nucleotides are only present in the antisense strand and are not present in the sense strand. In certain embodiments, there is a phase shift between the two strands such that the 2'-O-methyl modified nucleotide on the first strand base pairs with a non-modified nucleotide(s) on the second strand and vice versa. This particular arrangement, i.e. base pairing of 2'-O-methyl modified and non-modified nucleotide(s) on both strands is particularly preferred in certain embodiments. In certain embodiments, the pattern of alternating 2'-O-methyl modified nucleotides exists throughout the entire nucleic acid molecule; or the entire duplex region. In other embodiments the pattern of alternating 2'-O-methyl modified nucleotides exists only in a portion of the nucleic acid; or portion of the duplex region.

In "phase shift" patterns, it may be preferred if the antisense strand starts with a 2'-O-methyl modified nucleotide at the 5' end whereby consequently the second nucleotide is non-modified, the third, fifth, seventh and so on nucleotides are thus again 2'-O-methyl modified whereas the second, fourth, sixth, eighth and the like nucleotides are non-modified nucleotides.

Exemplary Modification Locations and Patterns of Nucleic Acid Compounds

While exemplary patterns are provided in more detail below, all permutations of patterns with all possible characteristics of the nucleic acid molecules disclosed herein and those known in the art are contemplated (e.g., characteristics include, but are not limited to, length of sense strand, length of antisense strand, length of duplex region, length of hangover, whether one or both ends of a double-stranded nucleic acid molecule is blunt or has an overhang, location of modified nucleic acid, number of modified nucleic acids, types of modifications, whether a double overhang nucleic acid molecule has the same or different number of nucleotides on the overhang of each side, whether a one or more than one type of modification is used in a nucleic acid molecule, and number of contiguous modified/unmodified nucleotides). With respect to all detailed examples provided below, while the duplex region is shown to be 19 nucleotides, the nucleic acid molecules provided herein can have a duplex region ranging from 1 to 40 nucleotides in length as each strand of a duplex region can independently be 17-40 nucleotides in length Exemplary patterns are provided herein.

Nucleic acid molecules may have a blunt end on both ends that include a single or contiguous set of modified nucleic acids. The modified nucleic acid may be located at any position along either the sense or antisense strand. Nucleic acid molecules may include a group of about 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, or 40 contiguous modified nucleotides. Modified nucleic acids may make up 1%, 2%, 3%, 5%, 10%, 15%, 20%, 25%, 30%, 35%, 40%, 45%, 50%, 55%, 60%, 65%, 70%, 75%, 80%, 85%, 90%, 95%, 97%, 98% or 100% of a nucleic acid strand. Modified nucleic acids of the examples immediately below may be in the sense strand only, the antisense strand only, or in both the sense strand and the antisense strand.

Nicks and Gaps in Nucleic Acid Strands

Nucleic acid molecules (e.g., siNA molecules) provided herein may have a strand, preferably the sense strand, that is nicked or gapped. As such, nucleic acid molecules may have three or more strand, for example, such as a meroduplex RNA (mdRNA) disclosed in International Patent Application No. PCT/US07/081,836. Nucleic acid molecules with a nicked or gapped strand may be RISC length (e.g., about 15 to 25 nucleotides) or Dicer substrate length (e.g., about 25 to 30 nucleotides).

Dicer Substrates

In certain embodiments, the nucleic acid molecules (e.g., siNA molecules) provided herein may be a precursor "Dicer substrate" molecule, e.g., double-stranded nucleic acid, processed in vivo to produce an active nucleic acid molecules, for example as described in Rossi, US Patent App. No. 20050244858. In certain conditions and situations, it has been found that these relatively longer dsRNA siNA species, e.g., of from about 25 to about 30 nucleotides, can give unexpectedly effective results in terms of potency and duration of action. Without wishing to be bound by any particular theory, it is thought that the longer dsRNA species serve as a substrate for the enzyme Dicer in the cytoplasm of a cell. In addition to cleaving double-stranded nucleic acid into shorter segments, Dicer may facilitate the incorporation of a single-stranded cleavage product derived from the cleaved dsRNA into the RNA-induced silencing complex (RISC complex) that is responsible for the destruction of the cytoplasmic RNA derived from the target gene.

Dicer substrates may have certain properties which enhance its processing by Dicer. Dicer substrates are of a length sufficient such that it is processed by Dicer to produce an active nucleic acid molecule and may further include one or more of the following properties: (i) the dsRNA is asymmetric, e.g., has a 3' overhang on the first strand (antisense strand) and (ii) the dsRNA has a modified 3' end on the second strand (sense strand) to direct orientation of Dicer binding and processing of the dsRNA to an active siRNA. In certain embodiments, the longest strand in the Dicer substrate may be 24-30 nucleotides.

Dicer substrates may be symmetric or asymmetric. The Dicer substrate may have a sense strand that includes 22-28 nucleotides and an antisense strand that may include 24-30 nucleotides; thus, in some embodiments the resulting Dicer substrate may have an overhang on the 3' end of the antisense strand. Dicer substrate may have a sense strand 25 nucleotides in length, and an antisense strand having 27 nucleotides in length with a 3'-overhang. The overhang may be 1-3 nucleotides, for example 2 nucleotides. The sense strand may also have a 5' phosphate.

Like other siNA molecules provided herein, the antisense strand of a Dicer substrate may have any sequence that anneals to the antisense strand under biological conditions, such as within the cytoplasm of a eukaryotic cell.

Dicer substrates may have any modifications to the nucleotide base, sugar or phosphate backbone as known in the art and/or as described herein for other nucleic acid molecules (such as siNA molecules). In certain embodiments, Dicer substrates may have a sense strand that is modified for Dicer processing by suitable modifiers located at the 3' end of the sense strand, i.e., the dsRNA is designed to direct orientation of Dicer binding and processing. Suitable modifiers include nucleotides such as deoxyribonucleotides, dideoxyribonucleotides, acyclonucleotides and the like and sterically hindered molecules, such as fluorescent molecules and the like. Acyclonucleotides substitute a 2-hydroxyethoxymethyl group for the 2'-deoxyribofuranosyl sugar normally present in deoxynucleoside monophosphates (dNMPs). Other nucleotide modifiers that could be used in Dicer substrate siNA molecules include 3'-deoxyadenosine (cordycepin), 3'-azido-3'-deoxythymidine (AZT), 2',3'-dideoxyinosine (ddI), 2',3'-dideoxy-3'-thiacytidine (3TC), 2',3'-didehydro-2',3'-dideoxythymidine (d4T) and the monophosphate nucleotides of 3'-azido-3'-deoxythymidine (AZT), 2',3'-dideoxy-3'-thiacytidine (3TC) and 2',3'-didehydro-2',3'-dideoxythymidine (d4T). In one embodiment, deoxynucleotides are used as the modifiers. When nucleotide modifiers are utilized, they may replace ribonucleotides (e.g., 1-3 nucleotide modifiers, or 2 nucleotide modifiers are substituted for the ribonucleotides on the 3' end of the sense strand) such that the length of the Dicer substrate does not change. When sterically hindered molecules are utilized, they may be attached to the ribonucleotide at the 3' end of the antisense strand. Thus, in certain embodiments the length of the strand does not change with the incorporation of the modifiers. In certain embodiments, two DNA bases in the dsRNA are substituted to direct the orientation of Dicer processing of the antisense strand. In a further embodiment, two terminal DNA bases are substituted for two ribonucleotides on the 3'-end of the sense strand forming a blunt end of the duplex on the 3' end of the sense strand and the 5' end of the antisense strand, and a two-nucleotide RNA overhang is located on the 3'-end of the antisense strand. This is an asymmetric composition with DNA on the blunt end and RNA bases on the overhanging end.

In certain embodiments modifications are included in the Dicer substrate such that the modification does not prevent the nucleic acid molecule from serving as a substrate for Dicer. In one embodiment, one or more modifications are made that enhance Dicer processing of the Dicer substrate. One or more modifications may be made that result in more effective RNAi generation. One or more modifications may be made that support a greater RNAi effect. One or more modifications are made that result in greater potency per each Dicer substrate to be delivered to the cell. Modifications may be incorporated in the 3'-terminal region, the 5'-terminal region, in both the 3'-terminal and 5'-terminal region or at various positions within the sequence. Any number and combination of modifications can be incorporated into the Dicer substrate so long as the modification does not prevent the nucleic acid molecule from serving as a substrate for Dicer. Where multiple modifications are present, they may be the same or different. Modifications to bases, sugar moieties, the phosphate backbone, and their combinations are contemplated. Either 5'-terminus can be phosphorylated.

The sense and antisense strands of the Dicer substrate are not required to be completely complementary. They only need to be substantially complementary to anneal under biological conditions and to provide a substrate for Dicer that produces an siRNA sufficiently complementary to the target sequence.

A region of one of the strands, particularly the antisense strand, of the Dicer substrate may have a sequence length of at least 19 nucleotides, wherein these nucleotides are in the 21-nucleotide region adjacent to the 3' end of the antisense strand and are sufficiently complementary to a nucleotide sequence of the RNA produced from the target gene. A Dicer substrate may also have one or more of the following additional properties: (a) the antisense strand has a right shift from a corresponding 21-mer (i.e., the antisense strand includes nucleotides on the right side of the molecule when compared to the corresponding 21-mer), (b) the strands may not be completely complementary, i.e., the strands may contain simple mismatch pairings and (c) base modifications such as locked nucleic acid(s) may be included in the 5' end of the sense strand.

An antisense strand of a Dicer substrate nucleic acid molecule may be modified to include 1-9 ribonucleotides on the 5'-end to give a length of 22-28 nucleotides. When the antisense strand has a length of 21 nucleotides, then 1-7 ribonucleotides, or 2-5 ribonucleotides and or 4 ribonucleotides may be added on the 3'-end. The added ribonucleotides may have any sequence. Although the added ribonucleotides may be complementary to the target gene sequence, full complementarity between the target sequence and the antisense strands is not required. That is, the resultant antisense strand is sufficiently complementary with the target sequence. A sense strand may then have 24-30 nucleotides. The sense strand may be substantially complementary with the antisense strand to anneal to the antisense strand under biological conditions. In one embodiment, the antisense strand may be synthesized to contain a modified 3'-end to direct Dicer processing. The sense strand may have a 3' overhang. The antisense strand may be synthesized to contain a modified 3'-end for Dicer binding and processing and the sense strand may have a 3' overhang.

Methods and Compositions for Inhibiting TLR2 and TLR4

In various aspects provided are compositions and methods for inhibition of TLR2 expression for treatment of lung disease, disorder or injury in a mammal. In various embodiments the method comprises administering to the mammal at least one therapeutic agent selected from a TLR2 inhibitor or a pharmaceutically acceptable salt or prodrug thereof; in an amount effect to treat the mammal. In various embodiments the therapeutic agent is selected from the group consisting of a small molecule chemical compound; a protein; an antibody or fragment thereof; and a nucleic acid molecule.

In various aspects provided are compositions and methods for inhibition of TLR2 and TLR4 expression for the treatment of lung disease, disorder or injury in a mammal. In various embodiments the method comprises administering to the mammal at least two therapeutic agents selected from: (i) a TLR2 inhibitor or a pharmaceutically acceptable salt or prodrug thereof and (ii) a TLR4 inhibitor or a pharmaceutically acceptable salt or prodrug thereof; in an amount effective to treat the mammal. In various embodiments each therapeutic agent is independently selected from the group consisting of a small molecule chemical compound; a protein; an antibody or fragment thereof; and a nucleic acid molecule.

In some embodiments, the therapeutic agent is a combined inhibitor by which it is meant a single agent which is capable of inhibiting the expression and/or activity of at least two genes and/or gene products of both: TLR2 and TLR4. Non-limiting examples of such single agents are tandem and multi-armed RNAi molecules disclosed in PCT Patent Publication No. WO 2007/091269.

In some embodiments a small nucleic acid molecule is selected from a short interfering nucleic acid (siNA), double-stranded nucleic acid (dsNA), interfering RNA (RNAi), short interfering RNA (siRNA), double-stranded RNA (dsRNA), micro-RNA (miRNA), and short hairpin RNA (shRNA) molecules capable of mediating or that mediate RNA interference against TLR2 and TLR4 gene expression. The composition and methods disclosed herein are also useful in treating or preventing inflammation and/or graft rejection associated with organ transplantation, in particular lung transplantation, including treatment, prevention or attenuation of progression of primary graft failure, ischemia-reperfusion injury, reperfusion injury, reperfusion edema, allograft dysfunction, pulmonary reimplantation response, bronchiolitis obliterans after lung transplantation and/or primary graft dysfunction (PGD) after organ transplantation, in particular lung transplantation.

Nucleic acid molecule(s) and/or methods provided herein may be used to down regulate the expression of gene(s) that encode RNA referred to, by example, Genbank Accession numbers NM_003264.3 (TLR2), NR_024169.1 (TLR4), NM_138554.3 (TLR4) and NR_024168.1 (TLR4).

Compositions, methods and kits provided herein may include one or more nucleic acid molecules (e.g., dsNA) and methods that independently or in combination modulate (e.g., down-regulate) the expression of TLR2 and TLR4 protein and/or genes encoding TLR2 and TLR4 proteins associated with the maintenance and/or development of diseases, conditions or disorders such as acute respiratory distress syndrome (ARDS), acute lung injury, pulmonary fibrosis (idiopathic), bleomycin induced pulmonary fibrosis, mechanical ventilation induced lung injury, chronic obstructive pulmonary disease (COPD), chronic bronchitis, emphysema, primary graft failure, ischemia-reperfusion injury, reperfusion injury, reperfusion edema, allograft dysfunction, pulmonary reimplantation response, bronchiolitis obliterans after lung transplantation and/or primary graft dysfunction (PGD) after organ transplantation, in particular in lung transplant (e.g., genes encoding sequences comprising those sequences referred to by GenBank Accession Nos. NM_003264.3, NR_024169.1, NM_138554.3 and NR_024168.1, or a TLR2 and TLR4 gene family member where the genes or gene family sequences share sequence homology). The description of the various aspects and embodiments is provided with reference to exemplary genes TLR2 and TLR4. However, the various aspects and embodiments are also directed to other related TLR2 and TLR4 genes, such as homolog genes and transcript variants, and polymorphisms (e.g., single nucleotide polymorphism, (SNPs)) associated with certain TLR2 and TLR4 genes. As such, the various aspects and embodiments are also directed to other genes that are involved in TLR2 and TLR4 mediated pathways of signal transduction or gene expression that are involved, for example, in the maintenance or development of diseases, traits, or conditions described herein. These additional genes can be analyzed for target sites using the methods described for the TLR2 and TLR4 genes herein. Thus, the modulation of other genes and the effects of such modulation of the other genes can be performed, determined, and measured as described herein.

In one embodiment, compositions and methods provided herein include a double-stranded short interfering nucleic acid (dsNA) molecule that down-regulates expression of TLR2 gene (e.g., human TLR2 exemplified by SEQ ID NO:1), where the nucleic acid molecule includes about 17 to about 40 base pairs.

In one embodiment, compositions and methods provided herein include a double-stranded short interfering nucleic acid (dsNA) molecules that down-regulates expression of TLR2 gene and TLR4 gene (e.g., human TLR2 exemplified by SEQ ID NO:1 and human TLR4 exemplified by SEQ ID NO:2, SEQ ID NO:3 or SEQ ID NO:4), where the nucleic acid molecules includes about 17 to about 40 base pairs.

In one embodiment, a nucleic acid disclosed herein may be used to inhibit the expression of the TLR2 and/or TLR4 gene or a TLR2 and/or TLR4 gene family where the genes or gene family sequences share sequence homology. Such homologous sequences can be identified as is known in the art, for example using sequence alignments. Nucleic acid molecules can be designed to target such homologous sequences, for example using perfectly complementary sequences or by incorporating non-canonical base pairs, for example mismatches and/or wobble base pairs, that can provide additional target sequences. In instances where mismatches are identified, non-canonical base pairs (for example, mismatches and/or wobble bases) can be used to generate nucleic acid molecules that target more than one gene sequence. In a non-limiting example, non-canonical base pairs such as UU and CC base pairs are used to generate nucleic acid molecules that are capable of targeting sequences for differing TLR2 and/or TLR4 targets that share sequence homology. As such, one advantage of using dsRNAs disclosed herein is that a single nucleic acid can be designed to include nucleic acid sequence that is complementary to the nucleotide sequence that is conserved between the homologous genes. In this approach, a single nucleic acid can be used to inhibit expression of more than one gene instead of using more than one nucleic acid molecule to target the different genes.

Nucleic acid molecules may be used to target conserved sequences corresponding to a gene family or gene families such as TLR2 and/or TLR4 family genes. As such, nucleic acid molecules targeting multiple TLR2 and/or TLR4 targets can provide increased therapeutic effect. In addition, nucleic acid can be used to characterize pathways of gene function in a variety of applications. For example, nucleic acid molecules can be used to inhibit the activity of target gene(s) in a pathway to determine the function of uncharacterized gene(s) in gene function analysis, mRNA function analysis, or translational analysis. The nucleic acid molecules can be used to determine potential target gene pathways involved in various diseases and conditions toward pharmaceutical development. The nucleic acid molecules can be used to understand pathways of gene expression involved in, for example acute respiratory distress syndrome (ARDS), acute lung injury, pulmonary fibrosis (idiopathic), bleomycin induced pulmonary fibrosis, mechanical ventilation induced lung injury, chronic obstructive pulmonary disease (COPD), chronic bronchitis, emphysema, bronchiolitis obliterans after lung transplantation, and/or inflammation and/or graft rejection, associated with organ transplantation-induced acute graft dysfunction, in particular lung transplantation-induced acute graft dysfunction.

In one embodiment, the compositions and methods provided herein include a nucleic acid molecule having RNAi activity against TLR2. In another embodiment, the compositions and methods provided herein include a nucleic acid molecule having RNAi activity against TLR2 RNA and a nucleic acid molecule having RNAi activity against TLR4 RNA, where the nucleic acid molecule includes a sequence complementary to any RNA having TLR2 and/or TLR4 encoding sequence. In another embodiment, a nucleic acid molecule may have RNAi activity against TLR2 and/or TLR4RNA, where the nucleic acid molecule includes a sequence complementary to an RNA having variant TLR2 and/or TLR4 encoding sequence, for example other mutant TLR2 and/or TLR4 genes known in the art to be associated with the maintenance and/or development of lung disease, disorder or injury as described herein. In another embodiment, a nucleic acid molecule disclosed herein includes a nucleotide sequence that can interact with nucleotide sequence of a TLR2 and/or TLR4 gene and thereby mediate silencing of TLR2 and/or TLR4, respectively, gene expression, for example, wherein the nucleic acid molecule mediates regulation of TLR2 and/or TLR4 gene expression by cellular processes that modulate the chromatin structure or methylation patterns of the TLR2 and/or TLR4 gene and prevent transcription of the TLR2 and/or TLR4 gene.

Antibody Therapy

In some embodiments the inhibitor or therapeutic agent as provided herein comprises and antibody. It should be understood that when the terms "antibody" or "antibodies" are used, this is intended to include intact antibodies, such as polyclonal antibodies or monoclonal antibodies (mAbs), as well as proteolytic fragments thereof such as the Fab or F(ab')$_2$ fragments. Further included within the scope of the provided methods and compositions are chimeric antibodies; human and humanized antibodies; recombinant and engineered antibodies, and fragments thereof. Furthermore, the DNA encoding the variable region of the antibody can be inserted into the DNA encoding other antibodies to produce chimeric antibodies (see, for example, U.S. Pat. No. 4,816,567). Single chain antibodies fall within the scope of the present inventions. Single chain antibodies can be single chain composite polypeptides having antigen binding capabilities and comprising amino acid sequences homologous or analogous to the variable regions of an immunoglobulin light and heavy chain (linked VH-VL or single chain Fv (ScFv)). Both $V_H$ and $V_L$ may copy natural monoclonal antibody sequences or one or both of the chains may comprise a CDR-FR construct of the type described in U.S. Pat. No. 5,091,513, the entire contents of which are hereby incorporated herein by reference. The separate polypeptides analogous to the variable regions of the light and heavy chains are held together by a polypeptide linker. Methods of production of such single chain antibodies, particularly where the DNA encoding the polypeptide structures of the $V_H$ and $V_L$ chains are known, may be accomplished in accordance with the methods described, for example, in U.S. Pat. Nos. 4,946,778, 5,091,513 and 5,096,815, the entire contents of each of which are hereby incorporated herein by reference.

Additionally, CDR grafting may be performed to alter certain properties of the antibody molecule including affinity or specificity. A non-limiting example of CDR grafting is disclosed in U.S. Pat. No. 5,225,539.

Methods of Treatment

Provided herein is a method for treating a lung disorder or injury in a mammal in need thereof comprising administering to the mammal at least one therapeutic agent selected from a TLR2 inhibitor or a pharmaceutically acceptable salt or prodrug; in an amount effect to treat the mammal.

In various embodiments the therapeutic agent is selected from the group consisting of a small molecule chemical compound; a protein; an antibody or fragment thereof; a peptide, a peptidomimetic and a nucleic acid molecule.

Provided herein is a method for treating a lung disorder or injury in a mammal in need thereof comprising administering to the mammal at least two therapeutic agents selected from: (i) at least one TLR2 inhibitor or a pharmaceutically acceptable salt or prodrug thereof and (ii) at least one TLR4 inhibitor or a pharmaceutically acceptable salt or prodrug thereof; in an amount effective to treat the mammal. In some embodiments the therapeutic agent is a combined inhibitor by which it is meant a single agent which is capable of inhibiting the expression and/or activity of both TLR2 gene or gene products thereof and TLR4 gene or gene products thereof.

In various embodiments each therapeutic agent is independently selected from the group consisting of a small molecule chemical compound; a protein; an antibody or fragment thereof; a peptide, a peptidomimetic and a nucleic acid molecule.

In one embodiment, nucleic acid molecules may be used to down-regulate or inhibit the expression of TLR2 and TLR4 proteins arising from TLR2 and TLR4 haplotype polymorphisms that are associated with a disease or condition, (e.g. lung disease, disorder or injury as described herein). Analysis of TLR2 and TLR4 genes, or TLR2 and TLR4 protein or RNA levels can be used to identify subjects with such polymorphisms or those subjects who are at risk of developing traits, conditions, or diseases described herein. These subjects are amenable to treatment, for example, treatment with nucleic acid molecules disclosed herein and any other composition useful in treating diseases related to TLR2 and/or TLR4 gene expression. As such, analysis of TLR2 and/or TLR4 protein or RNA levels can be used to determine treatment type and the course of therapy in treating a subject. Monitoring of TLR2 and/or TLR4 protein or RNA levels can be used to predict treatment outcome and to determine the efficacy of compounds and compositions that modulate the level and/or activity of certain TLR2 and/or TLR4 proteins associated with a trait, condition, or disease described herein.

In preferred embodiments the subject being treated is a warm-blooded animal and, in particular, mammals including human and non-human primates.

Provided are compositions and methods for inhibition of TLR2 and TLR4 expression by using small nucleic acid molecules as provided herein, such as short interfering nucleic acid (siNA), double-stranded nucleic acid (dsNA), interfering RNA (RNAi), short interfering RNA (siRNA), double-stranded RNA (dsRNA), micro-RNA (miRNA), and short hairpin RNA (shRNA) molecules capable of mediating or that mediate RNA interference against TLR2 and/or TLR4 gene expression. The composition and methods disclosed herein are also useful in treating various lung disorders and injury such as acute respiratory distress syndrome (ARDS), acute lung injury, pulmonary fibrosis (idiopathic), bleomycin induced pulmonary fibrosis, mechanical ventilator induced lung injury, chronic obstructive pulmonary disease (COPD), chronic bronchitis, emphysema, bronchiolitis obliterans after lung transplantation and lung transplantation-induced acute graft dysfunction. The compositions and methods disclosed herein are also useful in treating or preventing inflammation and/or graft rejection associated with organ transplantation, in particular lung transplantation, including treatment, prevention or attenuation of progression of primary graft failure, ischemia-reperfusion injury, reperfusion injury, reperfusion edema, allograft dysfunction, pulmonary reimplantation response, bronchiolitis obliterans after lung transplantation and/or primary graft dysfunction (PGD) after organ transplantation, in particular lung transplantation.

The nucleic acid molecules disclosed herein individually, or in combination or in conjunction with other drugs, can be use for preventing or treating diseases, traits, conditions and/or disorders associated with TLR2 and/or TLR4, such as lung disorders or injury and graft rejection associated with organ transplantation, in particular lung transplantation.

The nucleic acid molecules disclosed herein are able to down-regulate the expression of TLR2 and/or TLR4 in a sequence specific manner. The nucleic acid molecules may include a sense strand and an antisense strand, which includes contiguous nucleotides that are at least partially complementary (antisense) to a TLR2 and/or TLR4 mRNA.

In some embodiments, dsRNA specific for TLR2 and/or TLR4 can be used in conjunction with other dsRNA.

Lung disorders and injury can be treated by RNA interference using nucleic acid molecules as disclosed herein. Exemplary lung disorders and injuries are disclosed herein. The nucleic acid molecules disclosed herein may inhibit the expression of TLR2 and/or TLR4 in a sequence specific manner.

Treatment of lung injury can be monitored by determining the level of PaO2 using suitable techniques known in the art. Treatment can also be monitored by determining total and differential bronchoalveolar lavage (BAL) counts of different cell populations (e.g. neutrophils, lymphocytes, monocytes, eosinophils, basophils) using suitable techniques known in the art. Treatment can also be monitored by determining the level of TLR2 and/or TLR4 mRNA or the level of TLR2 and/or TLR4 protein in the cells of the affected tissue. Treatment can also be monitored by non-invasive scanning of the affected organ or tissue such as by computer assisted tomography scan, magnetic resonance elastography scans and other suitable techniques known in the art.

A method for treating or preventing TLR2 associated disease or condition in a subject or organism may include contacting the subject or organism with a nucleic acid molecule as provided herein under conditions suitable to down-regulate the expression of TLR2 gene in the subject or organism. A method for treating or preventing TLR2 and TLR4 associated disease or condition in a subject or organism may include contacting the subject or organism with nucleic acid molecules as provided herein under conditions suitable to down-regulate the expression of TLR2 and TLR4 genes in the subject or organism.

A method for treating or preventing lung disease, disorder or injury in a subject or organism may include contacting the subject or organism with a nucleic acid molecule under conditions suitable to down-regulate the expression of TLR2 gene in the subject or organism.

A method for treating or preventing lung disease, disorder or injury in a subject or organism may include contacting the subject or organism with a nucleic acid molecule under conditions suitable to down-regulate the expression of TLR2 gene and with a nucleic acid molecule under conditions suitable to down-regulate the expression of both, TLR4 gene, in the subject or organism.

A method for treating or preventing one or more lung diseases or disorders selected from the group consisting of acute respiratory distress syndrome (ARDS), acute lung injury, pulmonary fibrosis (idiopathic), bleomycin induced pulmonary fibrosis, mechanical ventilator induced lung injury, chronic obstructive pulmonary disease (COPD), chronic bronchitis, emphysema, bronchiolitis obliterans after lung transplantation and graft rejection associated with organ transplantation, in particular lung transplantation, in a subject or organism may include contacting the subject or organism with a nucleic acid molecule under conditions suitable to down-regulate the expression of TLR2 gene in the subject or organism.

A method for treating or preventing one or more lung diseases or disorders selected from the group consisting of acute respiratory distress syndrome (ARDS), acute lung injury, pulmonary fibrosis (idiopathic), bleomycin induced pulmonary fibrosis, mechanical ventilation induced lung injury, chronic obstructive pulmonary disease (COPD), chronic bronchitis, emphysema, bronchiolitis obliterans after lung transplantation and graft rejection associated with organ transplantation, in particular lung transplantation, in a subject or organism may include contacting the subject or organism with a nucleic acid molecule under conditions suitable to down-regulate the expression of TLR2 and with a nucleic acid molecule under conditions suitable to down-regulate the expression of TLR4 gene, in the subject or organism.

In various embodiments the provided methods of treating a lung disease, disorder or injury comprise inhibiting the gene Toll-like receptor 2 (TLR2) in combination with one or more additional treatment methods selected from the group consisting of surgery, steroid therapy, non-steroid therapy, anti-viral therapy, antifungal therapy, immunosuppressant therapy, anti-infective therapy, anti-hypertensive therapy and nutritional supplements. In various embodiments the provided methods of treating a lung disease, disorder or injury, comprise down-regulating the gene Toll-like receptor 2 (TLR2) in combination with immunosuppressant therapy.

In various embodiments the provided methods of treating a lung disease, disorder or injury comprise down-regulating the genes Toll-like receptor 2 (TLR2) and Toll-like receptor 4 (TLR4) in combination with one or more additional treatment methods selected from the group consisting of surgery, steroid therapy, non-steroid therapy, antiviral therapy, antifungal therapy, immunosuppressant therapy, anti-infective therapy, anti-hypertensive therapy and nutritional supplements. In various embodiments the provided methods of treating a lung disease, disorder or injury comprise down-regulating the Toll-like receptor 2 (TLR2) gene and down-regulating the Toll-like receptor 4 (TLR4) gene, in combination with immunosuppressant therapy.

Lung Disorders and Injury

The methods and compositions disclosed herein are useful in treating a subject experiencing or suffering from or at risk of suffering from acute respiratory distress syndrome (ARDS), acute lung injury, pulmonary fibrosis (idiopathic), bleomycin induced pulmonary fibrosis, mechanical ventilator induced lung injury, chronic obstructive pulmonary disease (COPD), chronic bronchitis, emphysema and medical complication of lung transplantation, including, without being limited to, primary graft failure, ischemia-reperfusion injury, reperfusion injury, reperfusion edema, allograft dysfunction, pulmonary reimplantation response, bronchiolitis obliterans after lung transplantation and/or primary graft dysfunction (PGD).

Acute Respiratory Distress Syndrome (ARDS)

ARDS is defined as an acute condition characterized by bilateral pulmonary infiltrates and severe hypoxemia in the absence of evidence for cardiogenic pulmonary edema. Acute respiratory distress syndrome (ARDS) is associated with diffuse alveolar damage (DAD) and lung capillary endothelial injury. The early phase is described as being exudative, whereas the later phase is fibroproliferative in character.

Early ARDS is characterized by an increase in the permeability of the alveolar-capillary barrier leading to an influx of fluid into the alveoli. The alveolar-capillary barrier is formed by the microvascular endothelium and the epithelial lining of the alveoli. Hence, a variety of insults resulting in damage either to the vascular endothelium or to the alveolar epithelium could result in ARDS. The main site of injury may be focused on either the vascular endothelium (e.g., sepsis) or the alveolar epithelium (e.g., aspiration of gastric contents).

Injury to the endothelium results in increased capillary permeability and the influx of protein-rich fluid into the alveolar space. Injury to the alveolar lining cells also promotes pulmonary edema formation. Two types of alveolar epithelial cells exist. Type I cells, comprising 90% of the alveolar epithelium, are injured easily. Damage to type I cells allows both increased entry of fluid into the alveoli and decreased clearance of fluid from the alveolar space. Type II cells have several important functions, including the production of surfactant, ion transport, and proliferation and differentiation into type I cells after cellular injury. Damage to type II cells results in decreased production of surfactant with resultant decreased compliance and alveolar collapse. Interference with the normal repair processes in the lung may lead to the development of fibrosis.

ARDS causes marked increase in intrapulmonary shunt, leading to severe hypoxemia. Although high inspired oxygen concentrations are required to maintain adequate tissue oxygenation and life, additional measures, like lung recruitment with positive end-expiratory pressure (PEEP), is often required. ARDS is uniformly associated with pulmonary hypertension. Pulmonary artery vasoconstriction likely contributes to ventilation-perfusion mismatch and is one of the mechanisms of hypoxemia in ARDS. Normalization of pulmonary artery pressures occurs as the syndrome resolves. Morbidity is considerable. Patients with ARDS are likely to have prolonged hospital courses, and they frequently develop nosocomial infections, especially ventilator-associated pneumonia. In addition, patients often have significant weight loss and muscle weakness and functional impairment may persist for months following hospital discharge. Most of the deaths in ARDS are attributable to sepsis or multiorgan failure rather than a primary pulmonary cause, although the recent success of mechanical ventilation using smaller tidal volumes may suggest a role of lung injury as a direct cause of death.

Acute Lung Injury (ALI)

Acute lung injury (ALI) is a diffuse heterogeneous lung injury characterized by hypoxemia, non cardiogenic pulmonary edema, low lung compliance and widespread capillary leakage. ALI is caused by any stimulus of local or systemic inflammation, principally sepsis.

There are two forms of ALI. Primary ALI is caused by a direct injury to the lung (e.g., pneumonia). Secondary ALI is caused by an indirect insult (e.g., pancreatitis). There are two stages—the acute phase characterized by disruption of the alveolar-capillary interface, leakage of protein rich fluid into the interstitium and alveolar space, and extensive release of cytokines and migration of neutrophils. A later reparative phase is characterized by fibroproliferation and remodeling of lung tissue.

The core pathology is disruption of the capillary-endothelial interface: this actually refers to two separate barriers—the endothelium and the basement membrane of the alveolus. In the acute phase of ALI, there is increased permeability of this barrier, and protein rich fluid leaks out of the capillaries. There are two types of alveolar epithelial cells—Type 1 pneumocytes represent 90% of the cell surface area, and are easily damaged. Type 2 pneumocytes are more resistant to damage, which is important as these cells produce surfactant, transportions and proliferate and differentiate into Type 1 cells.

The damage to the endothelium and the alveolar epithelium results in the creation of an open interface between the lung and the blood, facilitating the spread of micro-organisms from the lung systemically, stoking up a systemic inflammatory response. Moreover, the injury to epithelial cells handicaps the lung's ability to pump fluid out of airspaces. Fluid filled airspaces, loss of surfactant, microvascular thrombosis and disorganized repair (which leads to fibrosis) reduces resting lung volumes (decreased compliance), increasing ventilation-perfusion mismatch, right to left shunt and the work of breathing. In addition, lymphatic drainage of lung units appears to be curtailed—stunned by the acute injury: this contributes to the build up of extravascular fluid.

The patient has low lung volumes, atelectasis, loss of compliance, ventilation-perfusion mismatch (increased deadspace), and right to left shunt. Clinical features are—severe dyspnea, tachypnea, and resistant hypoxemia.

Prolonged inflammation and destruction of pneumocytes leads to fibroblastic proliferation, hyaline membrane formation and lung fibrosis. This fibrosing alveolitis may become apparent as early as five days after the initial injury. Subsequent recovery may be characterized by reduced physiologic reserve, and increased susceptibility to further lung injuries. Extensive microvascular thrombosis may lead to pulmonary hypertension, myocardial dysfunction and systemic hypotension.

Pulmonary Fibrosis (Idiopathic)

Idiopathic pulmonary fibrosis (IPF) is an idiopathic interstitial pneumonia that is characterized histopathologically by the presence of usual interstitial pneumonia. The hallmark pathologic feature of usual interstitial pneumonia is a heterogeneous, variegated appearance with alternating areas of healthy lung, interstitial inflammation, fibrosis, and honeycomb change. Fibrosis predominates over inflammation. Idiopathic pulmonary fibrosis portends a poor prognosis, and, to date, no proven effective therapies are available for the treatment of idiopathic pulmonary fibrosis beyond lung transplantation.

The etiology of idiopathic pulmonary fibrosis remains undefined; however, in the current hypothesis regarding the pathogenesis of idiopathic pulmonary fibrosis (IPF), exposure to an inciting agent (eg, smoke, environmental pollutants, environmental dust, viral infections, gastroesophageal reflux disease, chronic aspiration) in a susceptible host may lead to the initial alveolar epithelial damage. This damage may lead to activation of the alveolar epithelial cells, which provokes the migration, proliferation, and activation of mesenchymal cells with the formation of fibroblastic/myofibroblastic foci, leading to the exaggerated accumulation of extracellular matrix with the irreversible destruction of the lung parenchyma.

Other potential causes of idiopathic pulmonary fibrosis have been recognized through the study of familial pulmonary fibrosis. Familial pulmonary fibrosis may represent 20% of all cases of idiopathic pulmonary fibrosis. Genetic mutations in serum surfactant protein C have been discovered in some individuals with familial pulmonary fibrosis. It is believed these mutations in serum surfactant protein C may damage type II alveolar epithelial cells. Additionally, it has been described that mutant telomerase is associated with familial idiopathic pulmonary fibrosis.

Bleomycin Induced Pulmonary Fibrosis

Bleomycin is a glycopeptide antibiotic that was isolated from a strain of bacterium *Streptomyces verticillus*. Bleomycin refers to a family of structurally related compounds. When used as an anticancer agent, the chemotherapeutical forms are primarily bleomycin A2 and B2. It works by causing breaks in DNA. The drug is used in the treatment of variety of malignancies, including squamous cell carcinoma of the head and neck, cervix, and esophagus; germ cell tumors; testicular cancer; and both Hodgkin and non-Hodgkin lymphoma. Other anti-cancer drugs (such as for example cyclophosphamide and methotrexate) may cause lung fibrosis similarly to bleomycin.

A serious complication of bleomycin therapy is pulmonary fibrosis/interstitial pulmonary fibrosis (also called fibrosing alveolitis) and impaired lung function. Other, less common forms of lung injury include organizing pneumonia and hypersensitivity pneumonitis.

Chronic Obstructive Pulmonary Disease (COPD)

Chronic obstructive pulmonary disease (COPD), also known as chronic obstructive lung disease (COLD), chronic obstructive airway disease (COAD), chronic airflow limitation (CAL) and chronic obstructive respiratory disease (CORD), refers to chronic bronchitis and emphysema, a pair of commonly co-existing diseases of the lungs in which the airways become narrowed. This leads to a limitation of the flow of air to and from the lungs causing shortness of breath. In clinical practice, COPD is defined by its characteristically low airflow on lung function tests. In contrast to asthma, this limitation is poorly reversible and usually gets progressively worse over time.

COPD is caused by noxious particles or gas, most commonly from tobacco smoking, which triggers an abnormal inflammatory response in the lung. The inflammatory response in the larger airways is known as chronic bronchitis, which is diagnosed clinically when people regularly cough up sputum. In the alveoli, the inflammatory response causes destruction of the tissues of the lung, a process known as emphysema. The natural course of COPD is characterized by occasional sudden worsenings of symptoms called acute exacerbations, most of which are caused by infections or air pollution.

Both emphysematous destruction and small airway inflammation often are found in combination in individual patients, leading to the spectrum that is known as COPD. When emphysema is moderate or severe, loss of elastic recoil, rather than bronchiolar disease, is the mechanism of airflow limitation. By contrast, when emphysema is mild, bronchiolar abnormalities are most responsible for the deficit in lung function. Although airflow obstruction in emphysema is often irreversible, bronchoconstriction due to inflammation accounts for a limited amount of reversibility.

Pathological changes in chronic obstructive pulmonary disease (COPD) occur in the large (central) airways, the small (peripheral) bronchioles, and the lung parenchyma. The pathogenic mechanisms are not clear but most likely involve diverse mechanisms. The increased number of activated polymorphonuclear leukocytes and macrophages release elastases in a manner that cannot be counteracted effectively by antiproteases, resulting in lung destruction. The primary offender has been human leukocyte elastase, with a possible synergistic role suggested for proteinase 3 and macrophage-derived matrix proteinases, cysteine proteinases, and a plasminogen activator. Additionally, increased oxidative stress caused by free radicals in cigarette smoke, the oxidants released by phagocytes, and polymorphonuclear leukocytes all may lead to apoptosis or necrosis of exposed cells. Accelerated aging and autoimmune mechanisms have also been proposed as having roles in the pathogenesis of COPD.

Chronic Bronchitis

Chronic bronchitis is a chronic inflammation of the bronchi (medium-size airways) in the lungs. It is generally considered one of the two forms of chronic obstructive pulmonary disease (COPD). It is defined clinically as a persistent cough that produces sputum and mucus, for at least three months in two consecutive years. Mucous gland enlargement is the histologic hallmark of chronic bronchitis. The structural changes described in the airways include atrophy, focal squamous metaplasia, ciliary abnormalities, variable amounts of airway smooth muscle hyperplasia, inflammation, and bronchial wall thickening. Neutrophilia develops in the airway lumen, and neutrophilic infiltrates accumulate in the submucosa. The respiratory bronchioles display a mononuclear inflammatory process, lumen occlusion by mucous plugging, goblet cell metaplasia, smooth muscle hyperplasia, and distortion due to fibrosis. These changes, combined with loss of supporting alveolar attachments, cause airflow limitation by allowing airway walls to deform and narrow the airway lumen.

Emphysema

Emphysema is a long-term, progressive disease of the lungs that primarily causes shortness of breath. In people with emphysema, the tissues necessary to support the physical shape and function of the lungs are destroyed. It is included in a group of COPD. Emphysema is called an obstructive lung disease because the destruction of lung tissue around smaller sacs, called alveoli, makes these air sacs unable to hold their functional shape upon exhalation. It is often caused by smoking or long-term exposure to air pollution.

Emphysema has 3 morphologic patterns. The first type, centriacinar emphysema, is characterized by focal destruction limited to the respiratory bronchioles and the central portions of acinus. This form of emphysema is associated with cigarette smoking and is most severe in the upper lobes. The second type, panacinar emphysema, involves the entire alveolus distal to the terminal bronchiole. The panacinar type is most severe in the lower lung zones and generally develops in patients with homozygous alpha1-antitrypsin (AAT) deficiency. The third type, distal acinar emphysema or paraseptal emphysema, is the least common form and involves distal airway structures, alveolar ducts, and sacs. This form of emphysema is localized to fibrous septa or to the pleura and leads to formation of bullae. The apical bullae may cause pneumothorax. Paraseptal emphysema is not associated with airflow obstruction.

Lung Transplantation and its Complications

The term "lung transplantation" is meant to encompass a surgical procedure in which a patient's diseased lungs are partially or totally replaced by lungs which come from a donor. Although a xenotransplant can be contemplated in certain situations, an allotransplant is usually preferable.

Lung transplantation has become a treatment of choice for patients with advanced/end-stage lung diseases. Indications for lung transplantation include chronic obstructive pulmonary disease (COPD), pulmonary hypertension, cystic fibrosis, idiopathic pulmonary fibrosis, and Eisenmenger syndrome. Typically, four different surgical techniques are used: single-lung transplantation, bilateral sequential transplantation, combined heart-lung transplantation, and lobar transplantation, with the majority of organs obtained from deceased donors. Within last decades, donor management, organ preservation, immunosuppressive regimens and control of infectious complications have been substantially improved and the operative techniques of transplantation procedures have been developed. Nonetheless, primary graft dysfunction (PGD) affects an estimated 10 to 25% of lung transplants and is the leading cause of early post-transplantation morbidity and mortality for lung recipients (Lee J C and Christie J D. 2009. Proc Am Thorac Soc, vol. 6: 39-46). PGD manifests as an acute lung injury defined by diffuse infiltrates on chest x-ray and abnormal oxygenation. There, there is some evidence to suggest a relationship between reperfusion injury, acute rejection, and the subsequent development of chronic graft dysfunction. Chronic rejection, known as obliterative bronchiolitis/bronchiolitis obliterans syndrome (BOS), is the key reason why the five year survival is only 50%, which is significantly worse than most other solid organ transplants. Investigators have recently demonstrated that PGD increases the risk of the development of BOS independent of other risk factors, and the severity of PGD is directly associated with increased risk for BOS (Daud S A, Yusen R D et al. 2007 Am J Respir Crit Care Med. 2007; 175(5):507-513).

Bronchiolitis Obliterans after Lung Transplantation

Bronchiolitis obliterans, and its clinical correlate bronchiolitis obliterans syndrome, affect up to 50-60% of patients who survive 5 years after transplantation. In most patients, bronchiolitis obliterans is a progressive process that responds poorly to augmented immunosuppression, and it accounts for more than 30% of all deaths occurring after the third postoperative year. Survival at 5 years after the onset of bronchiolitis obliterans is only 30-40%, and survival at 5 years after transplantation is 20-40% lower in patients with than in patients without bronchiolitis obliterans.

The diagnosis of bronchiolitis obliterans is based on histology, but histologic proof is often difficult to obtain using transbronchial lung biopsies. Therefore, in 1993, a committee sponsored by the International Society for Heart and Lung Transplantation (ISHLT) proposed a clinical description of bronchiolitis obliterans, termed BOS, which is based on changes in $FEV_1$. For each patient, a stable post-transplant baseline $FEV_1$ is defined as BOS stage 0; in patients who experience a decrease in $FEV_1$, progressive stages of BOS, from 1 to 3, are defined according to the magnitude of the decrease. Although this classification system has been adopted by transplant centers worldwide as a useful descriptor of chronic allograft dysfunction, concern has been raised regarding its ability to detect small changes in pulmonary function. This concern recently led to formulation of a revised classification system for BOS, which includes a new "potential-BOS" stage (BOS 0-p) defined as a decrease in midexpiratory flow rates ($FE_{25-75}$) and/or $FEV_1$. The rationale for including $FEF_{25-75}$ comes from studies in heart-lung and bilateral lung recipients, which showed that this variable deteriorates before $FEV_1$ at the onset of BOS. The new BOS 0-p stage is meant to alert the physician and to indicate the need for close functional monitoring and for in-depth assessment using surrogate markers for BOS. However, the usefulness of stage BOS 0-p in recipients of single lungs, in particular those with emphysema, still needs to be established.

The histopathological features of bronchiolitis obliterans suggest that injury and inflammation of epithelial cells and subepithelial structures of small airways lead to excessive fibroproliferation due to ineffective epithelial regeneration and aberrant tissue repair. In parallel with the concept of "injury response" that has been proposed to explain chronic dysfunction of other organ allografts, airway injury may occur via alloimmune-dependent and -independent mechanisms acting alone or in combination. The evolving concept is that bronchiolitis obliterans represents a "final common pathway" lesion, in which various insults can lead to a similar histological and clinical result. Yet the rarity of this syndrome in untransplanted individuals suggests that alloimmune-dependent mechanisms usually play a pivotal role.

Delivery of Nucleic Acid Molecules and Pharmaceutical Formulations

Nucleic acid molecules may be adapted for use to prevent or treat lung diseases, injuries, traits, conditions and/or disorders, alone or in combination with other therapies. A nucleic acid molecule may include a delivery vehicle, including liposomes, for administration to a subject, carriers and diluents and their salts, and/or can be present in pharmaceutically acceptable formulations.

Nucleic acid molecules disclosed herein may be delivered or administered as the compound per se (i.e. naked nucleic acid molecule) or as pharmaceutically acceptable salt and may be delivered or administered alone or as an active ingredient in combination with one or more pharmaceutically acceptable carrier, solvent, diluent, excipient, adjuvant and/or vehicle. In some embodiments, nucleic acid molecules disclosed herein are delivered to the target tissue by direct application of the naked molecules prepared with a carrier or a diluent.

The term "naked nucleic acid molecule" refers to nucleic acid molecules that are free from any delivery vehicle that acts to assist, promote or facilitate entry into the cell, including e.g. viral vectors, viral sequences, viral particles, liposome formulations, lipofectin or precipitating agents and the like. For example, siRNA in PBS is "naked siRNA".

Nucleic acid molecules may be delivered or administered to a subject by direct application of the nucleic acid molecules with a carrier or diluent or any other delivery vehicle that acts to assist, promote or facilitate entry into a cell, including e.g. viral vectors, viral sequences, viral particular, liposome formulations, lipofectin or precipitating agents and the like. Polypeptides that facilitate introduction of nucleic acid into a desired subject are described in US Application Publication No. 20070155658 (e.g., a melamine derivative such as 2,4,6-Triguanidino Traizine and 2,4,6-Tramidosarcocyl Melamine, a polyarginine polypeptide, and a polypeptide including alternating glutamine and asparagine residues).

Methods for the delivery of nucleic acid molecules are described in Akhtar et al., Trends Cell Bio., 2: 139 (1992); Delivery Strategies for Antisense Oligonucleotide Therapeutics, ed. Akhtar, (1995), Maurer et al., Mol. Membr. Biol., 16: 129-140 (1999); Hofland and Huang, Handb. Exp. Pharmacol., 137: 165-192 (1999); and Lee et al., ACS Symp. Ser., 752: 184-192 (2000); U.S. Pat. Nos. 6,395,713; 6,235,310; 5,225,182; 5,169,383; 5,167,616; 4,959,217; 4,925,678; 4,487,603; and 4,486,194 and Sullivan et al., PCT WO 94/02595; PCT WO 00/03683 and PCT WO 02/08754; and U.S. Patent Application Publication No. 2003077829. These protocols can be utilized for the delivery of virtually any nucleic acid molecule. Nucleic acid molecules can be administered to cells by a variety of methods known to those of skill in the art, including, but not restricted to, encapsulation in liposomes, by iontophoresis, or by incorporation into other vehicles, such as biodegradable polymers, hydrogels, cyclodextrins (see e.g., Gonzalez et al., Bioconjugate Chem., 10:

1068-1074 (1999); Wang et al., International PCT publication Nos. WO 03/47518 and WO 03/46185), poly(lactic-co-glycolic)acid (PLGA) and PLCA microspheres (see for example U.S. Pat. No. 6,447,796 and U.S. Application Publication No. 2002130430), biodegradable nanocapsules, and bioadhesive microspheres, or by proteinaceous vectors (O'Hare and Normand, International PCT Publication No. WO 00/53722). Alternatively, the nucleic acid composition/combination is locally delivered by direct injection, oral instillation, inhalation or by use of an infusion pump. Direct injection of the nucleic acid molecules as provided herein, whether e.g. intratracheal, subcutaneous, intramuscular, or intradermal, can take place using standard needle and syringe methodologies, or by needle-free technologies such as those described in Conry et al., Clin. Cancer Res., 5: 2330-2337 (1999) and Barry et al., International PCT Publication No. WO 99/31262. The molecules provided herein can be used as pharmaceutical agents. Pharmaceutical agents prevent, modulate the occurrence, or treat (alleviate a symptom to some extent, preferably all of the symptoms) of a disease state in a subject.

Nucleic acid molecules may be complexed with cationic lipids, packaged within liposomes, or otherwise delivered to target cells or tissues. The nucleic acid or nucleic acid complexes can be locally administered to relevant tissues ex vivo, or in vivo through direct dermal application, transdermal application, or injection, with or without their incorporation in biopolymers.

Delivery systems include surface-modified liposomes containing poly (ethylene glycol) lipids (PEG-modified, or long-circulating liposomes or stealth liposomes). These formulations offer a method for increasing the accumulation of drugs in target tissues. This class of drug carriers resists opsonization and elimination by the mononuclear phagocytic system (MPS or RES), thereby enabling longer blood circulation times and enhanced tissue exposure for the encapsulated drug (Lasic et al. Chem. Rev. 1995, 95, 2601-2627; Ishiwata et al., Chem. Pharm. Bull. 1995, 43, 1005-1011).

Nucleic acid molecules may be formulated or complexed with polyethylenimine (e.g., linear or branched PEI) and/or polyethylenimine derivatives, including for example polyethyleneimine-polyethyleneglycol-N-acetylgalactosamine (PEI-PEG-GAL) or polyethyleneiminepolyethylene-glycol-tri-N-acetylgalactosamine (PEI-PEG-triGAL) derivatives, grafted PEIs such as galactose PEI, cholesterol PEI, antibody derivatized PEI, and polyethylene glycol PEI (PEG-PEI) derivatives thereof (see for example Ogris et al., 2001, AAPA PharmSci, 3, 1-11; Furgeson et al., 2003, Bioconjugate Chem., 14, 840-847; Kunath et al., 2002, Pharmaceutical Research, 19, 810-817; Choi et al., 2001, Bull. Korean Chem. Soc., 22, 46-52; Bettinger et al., 1999, Bioconjugate Chem., 10, 558-561; Peterson et al., 2002, Bioconjugate Chem., 13, 845-854; Erbacher et al., 1999, Journal of Gene Medicine Preprint, 1, 1-18; Godbey et al., 1999, PNAS USA, 96, 5177-5181; Godbey et al., 1999, Journal of Controlled Release, 60, 149-160; Diebold et al., 1999, Journal of Biological Chemistry, 274, 19087-19094; Thomas and Klibanov, 2002, PNAS USA, 99, 14640-14645; Sagara, U.S. Pat. No. 6,586,524 and United States Patent Application Publication No. 20030077829).

Nucleic acid molecules may be complexed with membrane disruptive agents such as those described in U.S. Patent Application Publication No. 20010007666. The membrane disruptive agent or agents and the nucleic acid molecule may also be complexed with a cationic lipid or helper lipid molecule, such as those lipids described in U.S. Pat. No. 6,235,310.

The nucleic acid molecules may be delivered or administered via a pulmonary delivery, such as by inhalation of an aerosol or spray dried formulation administered by an inhalation device or nebulizer, providing rapid local uptake of the nucleic acid molecules into relevant pulmonary tissues. Solid particulate compositions containing respirable dry particles of micronized nucleic acid compositions can be prepared by grinding dried or lyophilized nucleic acid compositions, and then passing the micronized composition through, for example, a 400 mesh screen to break up or separate out large agglomerates. A solid particulate composition comprising the nucleic acid compositions provided herein can optionally contain a dispersant which serves to facilitate the formation of an aerosol as well as other therapeutic compounds. A suitable dispersant is lactose, which can be blended with the nucleic acid compound in any suitable ratio, such as a 1 to 1 ratio by weight.

Aerosols of liquid particles may include a nucleic acid molecules disclosed herein and can be produced by any suitable means, such as with a nebulizer (see e.g., U.S. Pat. No. 4,501,729). Nebulizers are commercially available devices which transform solutions or suspensions of an active ingredient into a therapeutic aerosol mist either by means of acceleration of a compressed gas, typically air or oxygen, through a narrow venturi orifice or by means of ultrasonic agitation. Suitable formulations for use in nebulizers include the active ingredient(s) in a liquid carrier in an amount of up to 40% w/w preferably less than 20% w/w of the formulation. The carrier is typically water or a dilute aqueous alcoholic solution, preferably made isotonic with body fluids by the addition of, e.g., sodium chloride or other suitable salts. Optional additives include preservatives if the formulation is not prepared sterile, e.g., methyl hydroxybenzoate, anti-oxidants, flavorings, volatile oils, buffering agents and emulsifiers and other formulation surfactants. The aerosols of solid particles including the active composition and surfactant can likewise be produced with any solid particulate aerosol generator. Aerosol generators for administering solid particulate therapeutics to a subject produce particles, which are respirable, as explained above, and generate a volume of aerosol containing a predetermined metered dose of a therapeutic composition at a rate suitable for human administration. One illustrative type of solid particulate aerosol generator is an insufflator. Suitable formulations for administration by insufflation include finely comminuted powders, which can be delivered by means of an insufflator. In the insufflator, the powder, e.g., a metered dose thereof effective to carry out the treatments described herein, is contained in capsules or cartridges, typically made of gelatin or plastic, which are either pierced or opened in situ and the powder delivered by air drawn through the device upon inhalation or by means of a manually-operated pump. The powder employed in the insufflator consists either solely of the active ingredient or of a powder blend comprising the active ingredient(s), a suitable powder diluent, such as lactose, and an optional surfactant. The active ingredient(s) typically includes from 0.1 to 100 w/w of the formulation. A second type of illustrative aerosol generator includes a metered dose inhaler. Metered dose inhalers are pressurized aerosol dispensers, typically containing a suspension or solution formulation of the active ingredient in a liquefied propellant. During use these devices discharge the formulation through a valve adapted to deliver a metered volume to produce a fine particle spray containing the active ingredient(s). Suitable propellants include certain chlorofluorocarbon compounds, e.g., dichlorodifluoromethane, trichlorofluoromethane, dichlorotetrafluoroethane and mixtures thereof. The formulation can additionally contain one or more cosolvents, for example, ethanol, emulsifiers and other formulation surfactants, such as oleic acid or sorbitan trioleate, anti-oxidants and suitable flavoring agents. Other methods for pulmonary delivery are described in, e.g., US Patent Application Publication No. 20040037780, and U.S. Pat. Nos. 6,592,904; 6,582,728; 6,565,885.

Delivery systems may include, for example, aqueous and nonaqueous gels, creams, multiple emulsions, microemulsions, liposomes, ointments, aqueous and nonaqueous solutions, lotions, aerosols, hydrocarbon bases and powders, and can contain excipients such as solubilizers, permeation enhancers (e.g., fatty acids, fatty acid esters, fatty alcohols and amino acids), and hydrophilic polymers (e.g., polycarbophil and polyvinylpyrrolidone). In one embodiment, the pharmaceutically acceptable carrier is a liposome or a transdermal enhancer. Examples of liposomes which can be used in accordance with the compositions and methods provided herein include the following: (1) CellFectin, 1:1.5 (M/M) liposome formulation of the cationic lipid N,NI,NII,NIII-tetramethyl-N,NI,NII,NIII-tetrapalmit-y-spermine and dioleoyl phosphatidyl-ethanolamine (DOPE) (GIBCO BRL); (2) Cytofectin GSV, 2:1 (M/M) liposome formulation of a cationic lipid and DOPE (Glen Research); (3) DOTAP (N-[1-(2,3-dioleoyloxy)-N,N,N-tri-methyl-ammoniummethylsulfate] (Boehringer Manheim); and (4) Lipofectamine, 3:1 (M/M) liposome formulation of the polycationic lipid DOSPA, the neutral lipid DOPE (GIBCO BRL) and Di-Alkylated Amino Acid (DiLA2).

Nucleic acid molecules may include a bioconjugate, for example a nucleic acid conjugate as described in Vargeese et al., U.S. Ser. No. 10/427,160; U.S. Pat. Nos. 6,528,631; 6,335,434; 6,235,886; 6,153,737; 5,214,136; 5,138,045.

Expression of Nucleic Acid Molecules

Compositions, methods and kits disclosed herein may include an expression vector that includes a nucleic acid sequence encoding at least one nucleic acid molecule of such as provided herein in a manner that allows expression of the nucleic acid molecule. Methods of introducing nucleic acid molecules or one or more vectors capable of expressing the strands of dsRNA into the environment of the cell will depend on the type of cell and the make up of its environment. The nucleic acid molecule or the vector construct may be directly introduced into the cell (i.e., intracellularly); or introduced extracellularly into a cavity, interstitial space, into the circulation of an organism, introduced orally, or may be introduced by bathing an organism or a cell in a solution containing dsRNA. The cell is preferably a mammalian cell; more preferably a human cell. The nucleic acid molecule of the expression vector can include a sense region and an antisense region. The antisense region can include a sequence complementary to a RNA or DNA sequence encoding a gene selected from a TLR2 gene and a TLR4 gene; and the sense region can include a sequence complementary to the antisense region. The nucleic acid molecule can include two distinct strands having complementary sense and antisense regions. The nucleic acid molecule can include a single strand having complementary sense and antisense regions.

Nucleic acid molecules that interact with target RNA molecules and down-regulate gene encoding target RNA molecules (e.g., target RNA molecules referred to by Genbank Accession numbers herein) may be expressed from transcription units inserted into DNA or RNA vectors. Recombinant vectors can be DNA plasmids or viral vectors. Nucleic acid molecule expressing viral vectors can be constructed based on, but not limited to, adeno-associated virus, retrovirus, adenovirus, or alphavirus. The recombinant vectors capable of expressing the nucleic acid molecules can be delivered as described herein, and persist in target cells. Alternatively, viral vectors can be used that provide for transient expression of nucleic acid molecules. Such vectors can be repeatedly administered as necessary. Once expressed, the nucleic acid molecules bind and down-regulate gene function or expression via RNA interference (RNAi). Delivery of nucleic acid molecule expressing vectors can be systemic, such as by intravenous or intramuscular administration, by direct administration to the lung, e.g. by intratracheal injection, by administration to target cells ex-planted from a subject followed by reintroduction into the subject, or by any other means that would allow for introduction into the desired target cell.

Expression vectors may include a nucleic acid sequence encoding at least one nucleic acid molecule disclosed herein, in a manner which allows expression of the nucleic acid molecule. For example, the expression vector may encode one or both strands of a nucleic acid duplex, or a single self-complementary strand that self hybridizes into a nucleic acid duplex. The nucleic acid sequences encoding nucleic acid molecules can be operably linked in a manner that allows expression of the nucleic acid molecule. Non-limiting examples of such expression vectors are described in Paul et al., 2002, Nature Biotechnology, 19, 505; Miyagishi and Taira, 2002, Nature Biotechnology, 19, 497; Lee et al., 2002, Nature Biotechnology, 19, 500; and Novina et al., 2002, Nature Medicine, advance online publication doi:10.1038/nm725. Expression vectors may also be included in a mammalian (e.g., human) cell.

An expression vector may include a nucleic acid sequence encoding two or more nucleic acid molecules, which can be the same or different. Expression vectors may include a sequence for a nucleic acid molecule complementary to a nucleic acid molecule referred to by a Genbank Accession number NM_003264.3 (TLR2), NR_024169.1 (TLR4), NM_138554.3 (TLR4) or NR_024168.1 (TLR4).

An expression vector may include one or more of the following: a) a transcription initiation region (e.g., eukaryotic pol I, II or III initiation region); b) a transcription termination region (e.g., eukaryotic pol I, II or III termination region); c) an intron and d) a nucleic acid sequence encoding at least one of the nucleic acid molecules, wherein said sequence is operably linked to the initiation region and the termination region in a manner that allows expression and/or delivery of the nucleic acid molecule. The vector can optionally include an open reading frame (ORF) for a protein operably linked on the 5'-side or the 3'-side of the sequence encoding the nucleic acid molecule; and/or an intron (intervening sequences).

Transcription of the nucleic acid molecule sequences can be driven from a promoter for eukaryotic RNA polymerase I (pol I), RNA polymerase II (pol II), or RNA polymerase III (pol III). Transcripts from pol II or pol III promoters are expressed at high levels in all cells; the levels of a given pol II promoter in a given cell type depends on the nature of the gene regulatory sequences (enhancers, silencers, etc.) present nearby. Prokaryotic RNA polymerase promoters are also used, providing that the prokaryotic RNA polymerase enzyme is expressed in the appropriate cells (Elroy-Stein and Moss, 1990, PNAS USA, 87, 6743-7; Gao and Huang 1993, Nucleic Acids Res., 21, 2867-72; Lieber et al., 1993, Methods Enzymol., 217, 47-66; Zhou et al., 1990, Mol. Cell. Biol., 10, 4529-37). Several investigators have demonstrated that nucleic acid molecules expressed from such promoters can function in mammalian cells (e.g. Kashani-Sabet et al., 1992, Antisense Res. Dev., 2, 3-15; Ojwang et al., 1992, PNAS USA, 89, 10802-6; Chen et al., 1992, Nucleic Acids Res., 20, 4581-9; Yu et al., 1993, PNAS USA, 90, 6340-4; L'Huillier et al., 1992, EMBO J., 11, 4411-8; Lisziewicz et al., 1993, PNAS USA, 90, 8000-4; Thompson et al., 1995, Nucleic Acids Res., 23, 2259; Sullenger & Cech, 1993, Science, 262, 1566). More specifically, transcription units such as the ones derived from genes encoding U6 small nuclear RNA (snRNA), transfer RNA (tRNA) and adenovirus VA RNA are useful in generating high concentrations of desired RNA molecules such as siNA in cells (Thompson et al., supra; Couture and Stinchcomb, 1996, supra; Noonberg et al., 1994, Nucleic Acid Res., 22, 2830; Noonberg et al., U.S. Pat. No. 5,624,803; Good et al., 1997, Gene Ther., 4, 45; Beigelman et al., International PCT Publication No. WO 96/18736). The above nucleic acid transcription units can be incorporated into a variety of vectors for introduction into mammalian cells, including but not restricted to, plasmid DNA vectors, viral DNA vectors (such as adenovirus or adeno-associated virus vectors), or viral RNA vectors (such as retroviral or alphavirus vectors) (see Couture and Stinchcomb, 1996 supra).

A nucleic acid molecule may be expressed within cells from eukaryotic promoters (e.g., Izant and Weintraub, 1985, Science, 229, 345; McGarry and Lindquist, 1986, PNAS USA 83, 399; Scanlon et al., 1991, PNAS USA, 88, 10591-5; Kashani-Sabet et al., 1992, Antisense Res. Dev., 2, 3-15; Dropulic et al., 1992, J. Virol., 66, 1432-41; Weerasinghe et al., 1991, J. Virol., 65, 5531-4; Ojwang et al., 1992, PNAS USA, 89, 10802-6; Chen et al., 1992, Nucleic Acids Res., 20, 4581-9; Sarver et al., 1990 Science, 247, 1222-1225; Thompson et al., 1995, Nucleic Acids Res., 23, 2259; Good et al., 1997, Gene Therapy, 4, 45). Those skilled in the art realize that any nucleic acid can be expressed in eukaryotic cells from the appropriate DNA/RNA vector. The activity of such nucleic acids can be augmented by their release from the primary transcript by a enzymatic nucleic acid (Draper et al., PCT WO 93/23569, and Sullivan et al., PCT WO 94/02595; Ohkawa et al., 1992, Nucleic Acids Symp. Ser., 27, 15-6; Taira et al., 1991, Nucleic Acids Res., 19, 5125-30; Ventura et al., 1993, Nucleic Acids Res., 21, 3249-55; Chowrira et al., 1994, J. Biol. Chem., 269, 25856).

A viral construct packaged into a viral particle would accomplish both efficient introduction of an expression construct into the cell and transcription of dsRNA construct encoded by the expression construct.

Methods for oral introduction include direct mixing of RNA with food of the organism, as well as engineered approaches in which a species that is used as food is engineered to express an RNA, then fed to the organism to be affected. Physical methods may be employed to introduce a nucleic acid molecule solution into the cell. Physical methods of introducing nucleic acids include injection of a solution containing the nucleic acid molecule, bombardment by particles covered by the nucleic acid molecule, soaking the cell or organism in a solution of the RNA, or electroporation of cell membranes in the presence of the nucleic acid molecule.

Other methods known in the art for introducing nucleic acids to cells may be used, such as lipid-mediated carrier transport, chemical mediated transport, such as calcium phosphate, and the like. Thus the nucleic acid molecules may be introduced along with components that perform one or more of the following activities: enhance RNA uptake by the cell, promote annealing of the duplex strands, stabilize the annealed strands, or otherwise increase inhibition of the target gene.

Nucleic Acid Formulations

The nucleic acid molecules or the vector construct can be introduced into the cell using suitable formulations, e.g. a lipid formulation such as in Lipofectamine™ 2000 (Invitrogen, CA, USA), vitamin A coupled liposomes (Sato et al. Nat Biotechnol 2008; 26:431-442, PCT Patent Publication No. WO 2006/068232). Lipid formulations can also be administered to animals such as by intravenous, intramuscular, or intraperitoneal injection, or intratracheal injection, or orally or by inhalation or other methods as are known in the art. When the formulation is suitable for administration into animals such as mammals and more specifically humans, the formulation is also pharmaceutically acceptable. Pharmaceutically acceptable formulations for administering oligonucleotides are known and can be used. In some instances, it may be preferable to formulate nucleic acid molecules, e.g. dsRNA, in a buffer or saline solution and directly inject the formulated dsRNA into the target organ or into target cells, as in studies with oocytes. The direct injection of dsRNA duplexes may also be done. For suitable methods of introducing dsRNA see for example U.S. published patent application No. 2004/0203145, 20070265220, which are incorporated herein by reference.

Pharmaceutically acceptable formulations for treating lung disorders or injury are known and can be used for administration of the therapeutic combinations disclosed herein. In some instances, the therapeutic compositions disclosed herein may be formulated for intravenous administration for systemic delivery, or as aerosols, for example for intranasal administration, or as nasal drops, for example for intranasal instillation, or as suitable for intratracheal instillation.

Polymeric nanocapsules or microcapsules facilitate transport and release of the encapsulated or bound nucleic acid molecule, e.g. dsRNA, into the cell. They include polymeric and monomeric materials, e.g. especially including polybutylcyanoacrylate. A summary of materials and fabrication methods has been published (see Kreuter, 1991). The polymeric materials which are formed from monomeric and/or oligomeric precursors in the polymerization/nanoparticle generation step, are per se known from the prior art, as are the molecular weights and molecular weight distribution of the polymeric material which a person skilled in the field of manufacturing nanoparticles may suitably select in accordance with the usual skill.

Nucleic acid molecules may be formulated as a microemulsion. A microemulsion is a system of water, oil and amphiphile which is a single optically isotropic and thermodynamically stable liquid solution. Typically microemulsions are prepared by first dispersing an oil in an aqueous surfactant solution and then adding a sufficient amount of a 4th component, generally an intermediate chain-length alcohol to form a transparent system.

Surfactants that may be used in the preparation of microemulsions include, but are not limited to, ionic surfactants, non-ionic surfactants, Brij 96, polyoxyethylene oleyl ethers, polyglycerol fatty acid esters, tetraglycerol monolaurate (ML310), tetraglycerol monooleate (MO310), hexaglycerol monooleate (PO310), hexaglycerol pentaoleate (PO500), decaglycerol monocaprate (MCA750), decaglycerol monooleate (MO750), decaglycerol sequioleate (SO750), decaglycerol decaoleate (DA0750), alone or in combination with cosurfactants. The cosurfactant, usually a short-chain alcohol such as ethanol, 1-propanol, and 1-butanol, serves to increase the interfacial fluidity by penetrating into the surfactant film and consequently creating a disordered film because of the void space generated among surfactant molecules.

Water Soluble Crosslinked Polymers

Delivery formulations can include water soluble degradable crosslinked polymers that include one or more degradable crosslinking lipid moiety, one or more PEI moiety, and/or one or more mPEG (methyl ether derivative of PEG (methoxypoly (ethylene glycol)).

The degradable crosslinking lipid moiety may be reacted with a polyethyleneimine (PEI) as shown in Scheme A below:

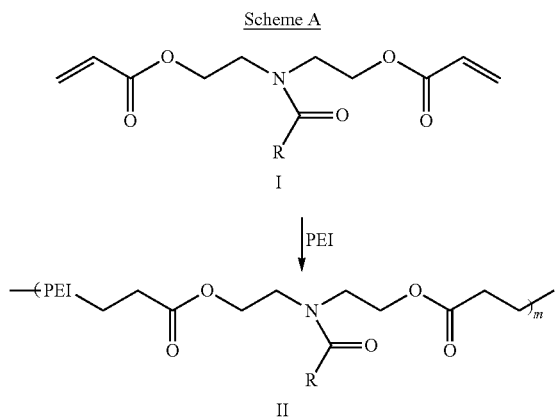

The reaction illustrated in Scheme A may be carried out by intermixing the PEI and the diacrylate (I) in a mutual solvent such as ethanol, methanol or dichloromethane with stirring, preferably at room temperature for several hours, then evaporating the solvent to recover the resulting polymer. While not wishing to be bound to any particular theory, it is believed that the reaction between the PEI and diacrylate (I) involves a Michael reaction between one or more amines of the PEI with double bond(s) of the diacrylate (see J. March, Advanced Organic Chemistry 3rd Ed., pp. 711-712 (1985)). The diacrylate shown in Scheme A may be prepared in the manner as described in U.S. application Ser. No. 11/216,986 (US Publication No. 2006/0258751).

The molecular weight of the PEI is preferably in the range of about 200 to 25,000 Daltons more preferably 400 to 5,000 Daltons, yet more preferably 600 to 2,000 Daltons. PEI may be either branched or linear.

The molar ratio of PEI to diacrylate is preferably in the range of about 1:2 to about 1:20. The weight average molecular weight of the cationic lipopolymer may be in the range of about 500 Daltons to about 1,000,000 Daltons preferably in the range of about 2,000 Daltons to about 200,000 Daltons. Molecular weights may be determined by size exclusion chromatography using PEG standards or by agarose gel electrophoresis.

The cationic lipopolymer is preferably degradable, more preferably biodegradable, e.g., degradable by a mechanism selected from the group consisting of hydrolysis, enzyme cleavage, reduction, photo-cleavage, and sonication. While not wishing to be bound to any particular theory, it is believed that degradation of the cationic lipopolymer of formula (II) within the cell proceeds by enzymatic cleavage and/or hydrolysis of the ester linkages.

Synthesis may be carried out by reacting the degradable lipid moiety with the PEI moiety as described above. Then the mPEG (methyl ether derivative of PEG (methoxypoly (ethylene glycol)), is added to form the degradable crosslinked polymer. In preferred embodiments, the reaction is carried out at room temperature. The reaction products may be isolated by any means known in the art including chromatographic techniques. In a preferred embodiment, the reaction product may be removed by precipitation followed by centrifugation.

Dose and Dosage Units

The useful dosage to be administered and the particular mode of administration will vary depending upon such factors as the cell type, or for in vivo use, the age, weight and the particular recipient and region thereof to be treated, the particular nucleic acid and delivery method used, the therapeutic or diagnostic use contemplated, and the form of the formulation, for example, suspension, emulsion, micelle or liposome, as will be readily apparent to those skilled in the art. Typically, dosage is administered at lower levels and increased until the desired effect is achieved.

When lipids are used to deliver the nucleic acid, the amount of lipid compound that is administered can vary and generally depends upon the amount of nucleic acid being administered. For example, the weight ratio of lipid compound to nucleic acid is preferably from about 1:1 to about 30:1, with a weight ratio of about 5:1 to about 10:1 being more preferred.

A suitable dosage unit of nucleic acid molecules may be in the range of about 0.001 to 20-100 milligrams per kilogram body weight of the recipient per day, or in the range of 0.01 to 20 milligrams per kilogram body weight per day, or in the range of 0.01 to 10 milligrams per kilogram body weight per day, or in the range of 0.1 to 5 milligrams per kilogram body weight per day, or in the range of 0.1 to 2.5 milligrams per kilogram body weight per day, in a regimen of a single dose or a series of doses given at short (e.g. 1-5 minute) or long (e.g. several hours) intervals.

In certain embodiment a suitable dosage unit of nucleic acid molecules may be in the range of about 0.01 mg, 0.02 mg, 0.03 mg, 0.04 mg, 0.05 mg, 0.0.6 mg, 0.07 mg, 0.08 mg, 0.09 mg, 0.1 mg, 0.2 mg, 0.3 mg, 0.4 mg, 0.5 mg, 0.6 mg, 0.7 mg, 0.8 mg, 0.9 mg, 1.0 mg, 1.1 mg, 1.2 mg, 1.3 mg, 1.4 mg, 1.5 mg, 1.6 mg, 1.7 mg, 1.8 mg, 1.9 mg, 2.0 mg, 2.1 mg, 2.2 mg, 2.3 mg, 2.4 mg, 2.5 mg, 2.6 mg, 2.7 mg, 2.8 mg, 2.9 mg, 3.0 mg, 3.1 mg, 3.2 mg, 3.3 mg, 3.4 mg, 3.5 mg, 3.6 mg, 3.7 mg, 3.8 mg, 3.9 mg, 4.0 mg, 4.1 mg, 4.2 mg, 4.3 mg, 4.4 mg, 4.5 mg, 4.6 mg, 4.7 mg, 4.8 mg, 4.9 mg, 5.0 mg, 5.1 mg, 5.2 mg, 5.3 mg, 5.4 mg, 5.5 mg, 5.6 mg, 5.7 mg, 5.8 mg, 5.9 mg, 6.0 mg, 6.1 mg, 6.2 mg, 6.3 mg, 6.4 mg, 6.5 mg, 6.6 mg, 6.7 mg, 6.8 mg, 6.9 mg, 7.0 mg, 7.1 mg, 7.2 mg, 7.3 mg, 7.4 mg, 7.5 mg, 7.6 mg, 7.7 mg, 7.8 mg, 7.9 mg, 8.0 mg, 8.1 mg, 8.2 mg, 8.3 mg, 8.4 mg, 8.5 mg, 8.6 mg, 8.7 mg, 8.8 mg, 8.9 mg, 9.0 mg, 9.1 mg, 9.2 mg, 9.3 mg, 9.4 mg, 9.5 mg, 9.6 mg, 9.7 mg, 9.8 mg, 9.9 mg, 10.0 mg, 10.1 mg, 10.2 mg, 10.3 mg, 10.4 mg, 10.5 mg, 10.6 mg, 10.7 mg, 10.8 mg, 10.9 mg, 11.0 mg, 11.1 mg, 11.2 mg, 11.3 mg, 11.4 mg, 11.5 mg, 11.6 mg, 11.7 mg, 11.8 mg, 11.9 mg, 12.0 mg, 12.1 mg, 12.2 mg, 12.3 mg, 12.4 mg, 12.5 mg, 12.6 mg, 12.7 mg, 12.8 mg, 12.9 mg, 13.0 mg, 13.1 mg, 13.2 mg, 13.3 mg, 13.4 mg, 13.5 mg, 13.6 mg, 13.7 mg, 13.8 mg, 13.9 mg, 14.0 mg, 14.1 mg, 14.2 mg, 14.3 mg, 14.4 mg, 14.5 mg, 14.6 mg, 14.7 mg, 14.8 mg, 14.9 mg, 15.0 mg, 15.1 mg, 15.2 mg, 15.3 mg, 15.4 mg, 15.5 mg, 15.6 mg, 15.7 mg, 15.8 mg, 15.9 mg, 16.0 mg, 16.1 mg, 16.2 mg, 16.3 mg, 16.4 mg, 16.5 mg, 16.6 mg, 16.7 mg, 16.8 mg, 16.9 mg, 17.0 mg, 17.1 mg, 17.2 mg, 17.3 mg, 17.4 mg, 17.5 mg, 17.6 mg, 17.7 mg, 17.8 mg, 17.9 mg, 18.0 mg, 18.1 mg, 18.2 mg, 18.3 mg, 18.4 mg, 18.5 mg, 18.6 mg, 18.7 mg, 18.8 mg, 18.9 mg, 19.0 mg, 19.1 mg, 19.2 mg, 19.3 mg, 19.4 mg, 19.5 mg, 19.6 mg, 19.7 mg, 19.8 mg, 19.9 mg, 20.0 mg per kilogram body weight of the recipient per day. in a regimen of a single dose or a series of doses given at short (e.g. 1-5 minute) or long (e.g. several hours) intervals.

Suitable amounts of nucleic acid molecules may be introduced and these amounts can be empirically determined using standard methods. Effective concentrations of individual nucleic acid molecule species in the environment of a cell may be about 1 femtomolar, about 50 femtomolar, 100 femtomolar, 1 picomolar, 1.5 picomolar, 2.5 picomolar, 5 picomolar, 10 picomolar, 25 picomolar, 50 picomolar, 100 picomolar, 500 picomolar, 1 nanomolar, 2.5 nanomolar, 5 nanomolar, 10 nanomolar, 25 nanomolar, 50 nanomolar, 100 nanomolar, 500 nanomolar, 1 micromolar, 2.5 micromolar, 5 micromolar, 10 micromolar, 100 micromolar or more.

Dosage of each therapeutic agent may be independently from about 0.01 μg to about 1 g per kg of body weight (e.g., 0.1 µg, 0.25 µg, 0.5 µg, 0.75 µg, 1 µg, 2.5 µg, 5 µg, 10 µg, 25 µg, 50 µg, 100 µg, 250 µg, 500 µg, 1 mg, 2.5 mg, 5 mg, 10 mg, 25 mg, 50 mg, 100 mg, 250 mg, or 500 mg, or 1 g, per kg of body weight).

In certain embodiments dosage levels of the order of from about 0.1 mg to about 140 mg per kilogram of body weight per day are useful in the treatment of the above-indicated conditions (about 0.5 mg to about 7 g per subject per day). The amount of active ingredient that can be combined with the carrier materials to produce a single dosage form varies depending upon the host treated and the particular mode of administration. Dosage unit forms generally contain between from about 1 mg to about 500 mg of an active ingredient.

In certain embodiments, the double-stranded RNA compound is present in the composition in a dose level of about 0.05 mg, 0.06 mg, 0.07 mg, 0.08 mg, 0.09 mg, 0.1 mg, 0.2 mg, 0.3 mg, 0.4 mg, 0.5 mg, 0.6 mg, 0.7 mg, 0.8 mg, 0.9 mg, 1.0 mg, 1.1 mg, 1.2 mg, 1.3 mg, 1.4 mg, 1.5 mg, 1.6 mg, 1.7 mg, 1.8 mg, 1.9 mg, 2.0 mg, 2.1 mg, 2.2 mg, 2.3 mg, 2.4 mg, 2.5 mg, 2.6 mg, 2.7 mg, 2.8 mg, 2.9 mg, 3.0 mg, 3.1 mg, 3.2 mg, 3.3 mg, 3.4 mg, 3.5 mg, 3.6 mg, 3.7 mg, 3.8 mg, 3.9 mg, 4.0 mg, 4.1 mg, 4.2 mg, 4.3 mg, 4.4 mg, 4.5 mg, 4.6 mg, 4.7 mg, 4.8 mg, 4.9 mg, 5.0 mg, 5.1 mg, 5.2 mg, 5.3 mg, 5.4 mg, 5.5 mg, 5.6 mg, 5.7 mg, 5.8 mg, 5.9 mg, 6.0 mg, 6.1 mg, 6.2 mg, 6.3 mg, 6.4 mg, 6.5 mg, 6.6 mg, 6.7 mg, 6.8 mg, 6.9 mg, 7.0 mg, 7.1 mg, 7.2 mg, 7.3 mg, 7.4 mg, 7.5 mg, 7.6 mg, 7.7 mg, 7.8 mg, 7.9 mg, 8.0 mg, 8.1 mg, 8.2 mg, 8.3 mg, 8.4 mg, 8.5 mg, 8.6 mg, 8.7 mg, 8.8 mg, 8.9 mg, 9.0 mg, 9.1 mg, 9.2 mg, 9.3 mg, 9.4 mg, 9.5 mg, 9.6 mg, 9.7 mg, 9.8 mg, 9.9 mg, or 10.0 mg per dose form.

It is understood that the specific dose level for any particular subject depends upon a variety of factors including the activity of the specific compound employed, the age, body weight, general health, sex, diet, time of administration, frequency of treatment, route of administration, and rate of excretion, drug combination and the severity of the particular disease undergoing therapy.

Regimens for continuing therapy, including dose and frequency may be guided by the initial response and clinical judgment.

The pulmonary route of administration is preferred, such as by intratracheal instillation, inhalation of an aerosol formulation, although other routes, may be required in specific administration, as for example to the mucous membranes of the nose, throat, bronchial tissues or lungs. Transdermal route of administration may also be used, including active systems where delivery is driven by microneedles or energy applied via ultrasound or lasers.

The therapeutic compositions disclosed herein are preferably administered into the lung of a subject suffering from lung injury, disorder, disease or who has undergone lung transplantation, by inhalation of an aerosol containing the composition/combination, by intranasal or intratracheal instillation or by inhalation via ventilation machine (e.g. for administration to an unconscious patient). In some embodiments the oligouncleotide compositions disclosed herein are administered by inhalation into the lung of a subject who has undergone lung transplantation. For further information on pulmonary delivery of pharmaceutical compositions see Weiss et al., Human Gene Therapy 1999. 10:2287-2293; Densmore et al., Molecular therapy 1999. 1:180-188; Gautam et al., Molecular Therapy 2001. 3:551-556; and Shahiwala & Misra, AAPS PharmSciTech 2004. 24; 6(3):E482-6. Additionally, respiratory formulations for dsRNA are described in U.S. Patent Application Publication No. 2004/0063654. Respiratory formulations for dsRNA are described in US Patent Application Publication No. 2004/0063654. International Patent Publication No. WO 2008/132723 to one of the assignees of the present invention, and hereby incorporated by reference in its entirety discloses therapeutic delivery of dsRNA to the respiratory system.

The dosage of each therapeutic agent is determined independently.

Pharmaceutical compositions that include the nucleic acid molecules disclosed herein may be administered once daily (q.d.), twice a day (b.i.d.), three times a day (t.i.d.), four times a day (q.i.d.), or at any interval and for any duration that is medically appropriate. However, the therapeutic agent may also be dosed in dosage units containing two, three, four, five, six or more sub-doses administered at appropriate intervals throughout the day. In that case, the nucleic acid molecules contained in each sub-dose may be correspondingly smaller in order to achieve the total daily dosage unit. The dosage unit can also be compounded for a single dose over several days, e.g., using a drug delivery pump; or using a conventional sustained release formulation which provides sustained and consistent release of the dsRNAs over a several day period. Sustained release formulations are well known in the art. The dosage unit may contain a corresponding multiple of the daily dose. The composition can be compounded in such a way that the sum of the multiple units of a nucleic acids together contain a sufficient dose.

Pharmaceutical Compositions, Kits, and Containers

Provided are compositions, kits, containers and formulations that include at least one therapeutic agents (e.g., small organic molecule chemical compound; protein, antibody, peptide, peptidomimetic and nucleic acid molecule) which target, decrease, down-regulate or inhibit the expression/activity/function of the gene TLR2, for administering to a patient.

Also provided are compositions, kits, containers and formulations that include at least two therapeutic agents (e.g., small organic molecule; protein, antibody, peptide, peptidomimetic and nucleic acid molecule), at least one therapeutic agent which target, decrease, down-regulate or inhibit the expression/activity/function of the gene TLR2 and at least one therapeutic agent which target, decrease, down-regulate or inhibit the expression/activity/function of the gene TLR4, for administering to a patient.

A kit may include at least one container and at least one label. Suitable containers include, for example, bottles, vials, syringes, and test tubes. The containers can be formed from a variety of materials such as glass, metal or plastic. The container can hold amino acid(s), small molecule(s), nucleic acid(s), protein(s), peptides(s), peptidomimetic(s), cell population(s) and/or antibody(s). In one embodiment, the container holds a composition that is effective for treating, diagnosing, prognosing or prophylaxing a condition described herein and can have a sterile access port (for example the container can be an intravenous solution bag or a vial having a stopper pierceable by a hypodermic injection needle). The active agent in the composition can be a nucleic acid molecule(s) capable of specifically binding TLR2 and/or modulating the function of TLR2. The active agent in the composition can be a nucleic acid molecule(s) capable of specifically binding TLR4 and/or modulating the function of TLR4. The active agents in the composition can be a nucleic acid molecule(s) capable of specifically binding TLR2 and TLR4 and/or modulating the function of TLR2 and TLR4.

Kits may further include associated indications and/or directions; reagents and other compositions or tools used for such purpose as described herein.

A kit may further include a second container that includes a pharmaceutically-acceptable buffer, such as phosphate-buffered saline, Ringer's solution and/or dextrose solution. It can further include other materials desirable from a commercial and user standpoint, including other buffers, diluents, filters, stirrers, needles, syringes, and/or package inserts with indications and/or instructions for use.

The units dosage ampules or multidose containers, in which the therapeutic agents are packaged prior to use, may include an hermetically sealed container enclosing an amount of therapeutic agent or solution containing a therapeutic agent suitable for a pharmaceutically effective dose thereof, or multiples of an effective dose. The therapeutic agent is packaged as a sterile formulation, and the hermetically sealed container is designed to preserve sterility of the formulation until use.

The container in which the therapeutic agent molecules are packaged may be labeled, and the label may bear a notice in the form prescribed by a governmental agency, for example the Food and Drug Administration, which notice is reflective of approval by the agency under Federal law, of the manufacture, use, or sale of the therapeutic material therein for human administration.

Federal law requires that the use of pharmaceutical compositions in the therapy of humans be approved by an agency of the Federal government. In the United States, enforcement is the responsibility of the Food and Drug Administration, which issues appropriate regulations for securing such approval, detailed in 21 U.S.C. §301-392. Regulation for biologic material, including products made from the tissues of animals is provided under 42 U.S.C. §262. Similar approval is required by most countries. Regulations vary from country to country, but individual procedures are well known to those in the art and the compositions and methods provided herein preferably comply accordingly.

As such, provided herein is a pharmaceutical product which may include a combination of nucleic acid molecules in solution in a pharmaceutically acceptable injectable carrier and suitable for administration to a patient, and a notice associated with the container in a form prescribed by a governmental agency regulating the manufacture, use, or sale of pharmaceuticals, which notice is reflective of approval by the agency of manufacture, use, or sale of the solution comprising the nucleic acids for human administration. Compositions, kits and methods disclosed herein may include packaging a nucleic acid molecule disclosed herein that includes a label or package insert. The label may include indications for use of the nucleic acid molecules such as use for treatment or prevention of lung disorders or injury in a human, including treatment of acute respiratory distress syndrome (ARDS), acute lung injury, pulmonary fibrosis (idiopathic), bleomycin induced pulmonary fibrosis, mechanical ventilator induced lung injury, chronic obstructive pulmonary disease (COPD), chronic bronchitis, emphysema, bronchiolitis obliterans after lung transplantation and lung transplantation-induced acute graft dysfunction, and any other disease or conditions that are related to or will respond to down-regulation of the expression of TLR2 in a cell or tissue, alone or in combination in combination with other therapies; or to down-regulation of the expression of TLR2 and TLR4, alone or in combination with other therapies. A label may include an indication for use in reducing expression of TLR2 gene. A label may include an indication for use in reducing expression of TLR2 gene and TLR4 gene. A "package insert" is used to refer to instructions customarily included in commercial packages of therapeutic products, that contain information about the indications, usage, dosage, administration, contraindications, other therapeutic products to be combined with the packaged product, and/or warnings concerning the use of such therapeutic products, etc.

Those skilled in the art will recognize that other lung disorder/injury treatments, drugs and therapies known in the art can be readily combined with the therapeutic combination disclosed herein and are hence contemplated herein.

The methods and compositions provided herein will now be described in greater detail by reference to the following non-limiting examples.

EXAMPLES

Example 1

Generation of Sequences for Active dsRNA Compounds to the TLR2 and TLR4 Genes and Production of the dsRNA Compounds Using proprietary algorithms and the known sequence of the genes disclosed herein, the antisense and corresponding sense sequences of dsRNA compounds were generated. In addition to the algorithm, 20-, 21-, 22-, and 23-mer oligomer sequences are generated by 5' and/or 3' extension of the 19-mer sequences. The sequences that have been generated using this method are fully complementary to a segment of corresponding mRNA sequence.

SEQ IDs Numbers 5-12,136 provide oligonucleotide sequences useful in the preparation of dsRNA compounds disclosed herein. Each sequence is presented in 5' to 3' orientation.

For each gene there is a separate list of 19-mer sense and corresponding antisense oligonucleotide sequences, which are prioritized based on their score in the proprietary algorithm as the best sequences for targeting the human gene expression.

The siRNA compounds disclosed herein are synthesized by any methods described herein, infra.

Example 2

Evaluation of Inhibitory Activity of dsRNA Compounds Targeting TLR2 and TLR4 Genes Inhibitory activity of dsRNA compounds is assessed in vitro by transfection of dsRNA compounds into human HeLa or human PC3 cells.

Preparation of Cells for dsRNA Transfection

HeLa cells (American Type Culture Collection) are cultured as described in Czauderna, et al. (NAR, 2003. 31:670-82).

In each well of a 6-well plate, 1X105 human HeLa cells (ATCC, Cat#CCL-2) are inoculated in 2 mL growth medium in order to reach 30-50% confluence one day later. Cells are then incubated in 37±1° C., 5% CO2 incubator for 24 hours. One day post inoculation, cell culture media is replaced with 1.5 mL fresh growth medium per well.

dsRNA Transfection

Following incubation, cells are transfected with dsRNA compounds using the Lipofectamine™ 2000 reagent (Invitrogen) at final concentrations ranging between 0.0035 nM to 100 nM (final dsRNA concentration in cell culture wells). Cells are then incubated in a 37±1° C., 5% CO2 incubator for 48 hours.

For the determination of transfection efficiency, cells are similarly transfected with a 20 nM solution of a Cy3-labeled dsRNA which targets the DDIT4 gene transcript.

As negative control, cells are similarly transfected with a scrambled sequence dsRNA (CNL_1) at final concentrations of 40 and 100 nM.

RNA Preparation for Real Time qPCR (qPCR)

At 48 h after transfection cells are harvested and RNA is extracted from cells isolated using EZ-RNA kit [Biological Industries (#20-410-100)].

Transfection efficiency is tested by fluorescent microscopy.

Determining Inhibitory Activity In Vitro

The percent of down-regulation of gene expression using specific dsRNA compounds dislosed herein is determined using qPCR analysis. The relative quantity of target gene mRNA is determined using as template RNA prepared from each of the dsRNA-transfected cell samples. dsRNA activity is determined based on the ratio of the target gene mRNA quantity in dsRNA-treated samples versus non-transfected control samples.

Chemically modified dsRNA compounds disclosed herein are tested in vitro as described and are shown to down-regulate target gene expression.

Example 3

Stability of dsRNA Compounds

Nuclease resistance of the dsRNA compounds disclosed herein is tested in human serum and/or in bronchoalveolar lavage fluid (BALF).

For stability testing, a dsRNA compound is diluted in human serum or in bronchoalveolar lavage fluid (BALF) to a required final concentration (e.g. 7 µM). A 5 µL aliquot is transferred to 15 µL of 1.5×TBE-loading buffer, immediately frozen in liquid nitrogen, and transferred to −20° C. This represents "Time Point 0". The remaining dsRNA solution is divided into 5 µL aliquots, which are incubated at 37° C. for 30 min, 1 h, 6 h, 8 h, 10 h, 16 h or 24 h.

Following incubation, dsRNA compound samples are transferred to 15 µL of 1.5×TBE-loading buffer. 5 µL of each dsRNA compound in loading buffer sample is loaded onto a non denaturing 20% polyacrylamide gel and electrophoresis is performed. The positive control, double-strand migration reference (a non-relevant, 19-base pairs, blunt-ended, double-stranded RNA with similar chemical modifications), and single-strand migration reference (a non-relevant ssRNA with chemical modifications), as well as the Time Point 0 sample are loaded on the same gel and electrophoresed in parallel.

For dsRNA visualization the gel is stained with Ethidium bromide solution (1.0 µg/4).

Stability of dsRNA compounds disclosed herein is determined by examining the migration pattern of dsRNA samples on PAGE following incubation in human serum and/or in bronchoalveolar lavage fluid (BALF).

Example 4

Efficacy of dsRNA in Mouse Models of Orthotopic Vascularized Aerated Lung Transplantation Therapeutic efficacy of dsRNA compounds described herein in preventing primary graft dysfunction caused by both prolonged cold ischemia and immune rejection was tested in syngeneic and allogeneic mouse orthotopic models of lung transplantation. The method of orthotopic vascularized aerated left lung transplantation in the mouse utilizes cuff techniques for the anastomosis of pulmonary artery, pulmonary veins and bronchus. This method has been reported in several publications (Okazaki et al., Am J Transplant, 2007; 7:1672-9 and Krupnick et al. Nature Protocols, 2009; vol. 4 No. 1:86-93).

dsRNA Test Compounds

One dsRNA compound targeting TLR4 (designated TLR4_4_S500) and two dsRNA compounds targeting TLR2 (designated TLR2_7_S73 and TLR2_4_S73) were tested in syngeneic mouse orthotopic models of lung transplantation. One dsRNA compound targeting TLR4 (designated TLR4_4_S500) and one dsRNA compounds targeting TLR2 (designated TLR2_4_S73) were tested in allogeneic mouse orthotopic models of lung transplantation. A dsRNA compound directed at enhanced green fluorescent protein (EGFP) (designated EGFP_5_S763) and/or vehicle (phosphate buffer solution (PBS)) served as negative control in these experiments.

Table 1 lists dsRNA compounds that were tested in syngeneic and allogeneic mouse orthotopic models of lung transplantation.

TABLE 1

| DsRNA compound | Target gene |
| --- | --- |
| TLR4_4_S500 | TLR4, toll-like receptor 4 |
| TLR2_7_S73 | TLR2, toll-like receptor 2 |
| TLR2_4_S73 | TLR2, toll-like receptor 2 |
| EGFP_5_S763 | EGFP, Enhanced green fluorescent protein |

Table 2 provides the sense strand and the antisense strand sequences of the dsRNA compounds that were tested in syngeneic and allogeneic mouse orthotopic models of lung transplantation. Table 2 further provides the cross species data.

TABLE 2

| DsRNA compound | Sense 5'->3' | Antisense 5'->3' | cross species |
| --- | --- | --- | --- |
| TLR4_4_S500 | GAGUUCAGGUUAACAUAUA | UAUAUGUUAACCUGAACUC | rat, mouse |
| TLR2_7_S73 | GCAAACUGCGCAAGAUAAU | AUUAUCUUGCGCAGUUUGC | rat, mouse |
| TLR2_4_S73 | CCUCUUUGAAAUACUUAAA | UUUAAGUAUUUCAAAGAGG | rat, mouse |
| EGFP_5_S763 | GGCUACGUCCAGGAGCGCACC | GGUGCGCUCCUGGACGUAGCC | 21-mer |

Table 3 provides the sense strand and the antisense strand modification patterns of the dsRNA compounds that were tested in syngeneic and allogeneic mouse orthotopic models of lung transplantation.

TABLE 3

| DsRNA compound | Sense 5'->3' | Antisense 5'->3' |
| --- | --- | --- |
| TLR4_4_S500 | 2'-OMe sugar modified ribonucleotides in positions: 2, 4, 6, 8, 10, 12, 14, 16 and 18 unmodified ribonucleotides in positions: 1, 3, 5, 7, 9, 11, 13, 15, 17 and 19 3'-terminal phosphate | 2'-OMe sugar modified ribonucleotides in positions: 1, 3, 5, 7, 9, 11, 13, 15, 17 and 19 unmodified ribonucleotides in positions: 2, 4, 6, 8, 10, 12, 14, 16 and 18 3'-terminal phosphate |

TABLE 3-continued

| DsRNA compound | Sense 5'->3' | Antisense 5'->3' |
| --- | --- | --- |
| TLR2__7__S73 | 2'-OMe sugar modified ribonucleotides in positions: 2, 4, 6, 8, 10, 12, 14, 16 and 18 unmodified ribonucleotides in positions: 1, 3, 5, 7, 9, 11, 13, 15, 17 and 19 No 3'-terminal phosphate | 2'-OMe sugar modified ribonucleotides in positions: 1, 3, 5, 7, 9, 11, 13, 15, 17 and 19 unmodified ribonucleotides in positions: 2, 4, 6, 8, 10, 12, 14, 16 and 18 No 3'-terminal phosphate |
| TLR2__4__S73 | 2'-OMe sugar modified ribonucleotides in positions: 2, 4, 6, 8, 10, 12, 14, 16 and 18 unmodified ribonucleotides in positions: 1, 3, 5, 7, 9, 11, 13, 15, 17 and 19 No 3'-terminal phosphate | 2'-OMe sugar modified ribonucleotides in positions: 1, 3, 5, 7, 9, 11, 13, 15, 17 and 19 unmodified ribonucleotides in positions: 2, 4, 6, 8, 10, 12, 14, 16 and 18 No 3'-terminal phosphate |
| EGFP__5__S763 | 2'-OMe sugar modified ribonucleotides in positions: 2, 4, 6, 8, 10, 12, 14, 16, 18 and 20 unmodified ribonucleotides in positions: 1, 3, 5, 7, 9, 11, 13, 15, 17, 19 and 21 No 3'-terminal phosphate | 2'-OMe sugar modified ribonucleotides in positions: 1, 3, 5, 7, 9, 11, 13, 15, 17, 19 and 21 unmodified ribonucleotides in positions: 2, 4, 6, 8, 10, 12, 14, 16, 18 and 20 No 3'-terminal phosphate |

Dosage and Administration dsRNA compounds were administered at the end of lung transplantation surgery (immediately after anastomosis opening), by intratracheal instillation to the recipient. The following doses of individual dsRNA compounds were tested in these animal models: 6 µg/mouse, 12.5 µg/mouse, 25 µg/mouse and 50 µg/mouse.

Mouse Syngeneic Lung Transplantation (C57B1/6-> C57B1/6)

Experimental Design

Both donor and recipient were C57BL/6 mice. Prior to transplantation ischemia reperfusion injury was induced by prolonged cold preservation of the lung transplant by 18 hours of cold storage in a low dextrose solution with components similar to solutions used to preserve human lung transplants (18 hours of cold ischemia time (CIT)). This method induced symptoms consistent with primary graft dysfunction 24 hours post-transplantation. Within 5-10 minutes after reperfusion 25 µg/mouse (or a different dose as described herein) of siRNA specific for control siRNA, TLR2, TLR4 or both TLR2 and TLR4 was administered down the trachea. Lung recipients were assessed 24 hours later for lung injury.

Administration

By intratracheal instillation of dsRNA solution to the lungs; 1 dose of a dsRNA compound or of a combination of dsRNA compounds is administered immediately after anastomosis opening on Day 0.

Evaluation

Lung recipients were evaluated at 24 hours post transplantation through assessing lung function, as measured by:

Gross pathology—appearance of pulmonary edema;

Pulmonary function in the post-transplanted lung—PaO2, oxygenation of arterial blood in the left pulmonary artery;

Intra-airway accumulation of cellular infiltrates; and

Total amount and differential counts of bronchoalveolar lavage (BAL) cells

Results

In this syngeneic model, mouse isografts exposed to prolonged cold ischemia (18 hours CIT) develop impaired oxygenation, pulmonary edema, increased inflammatory cytokine production and intra-graft and intra-airway accumulation of granulocytes as measured 24 hours post-transplantation. By contrast, mouse lung recipients of 1 hour cold preserved grafts (1 hour CIT) had little evidence of lung injury 24 hours post-transplantation.

Lung recipients that were treated with either dsRNA specific for TLR2 or with a combination of both dsRNA specific for TLR2 and dsRNA specific for TLR4 had significantly better function and significantly less BAL cellular infiltrate, as compared to other treatment groups and to the negative control animals (treated with vehicle or with dsRNA specific for EGFP).

Figure 1:
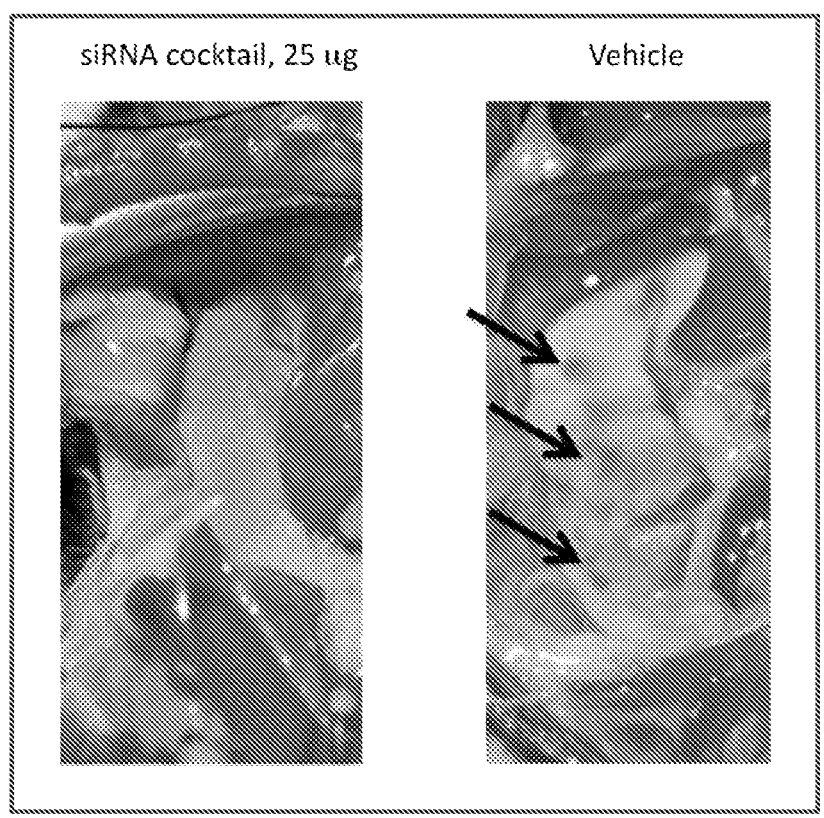
FIG. 1 shows that combined administration of a double-stranded RNA (dsRNA) specific for TLR2, at a dose of 25 µg/mouse and a double-stranded RNA (dsRNA) specific for TLR4, at a dose of 25 µg/mouse efficiently reduced post-transplantation lung edema and hemorrhages in the transplanted mouse lung. Photographs of the recipient's lung were taken at 24 hours after orthotopic lung transplantation. Left: dsRNA combination (combination of dsRNA specific for TLR2 and dsRNA specific for TLR4, each at 25 µg/mouse (identified in the figure as "siRNA cocktail, 25 µg")) was administered at the end of lung transplantation surgery (immediately after anastomosis opening), by intratracheal instillation to the recipient. Right: vehicle. Arrows: prominent hemorrhages.

FIG. 1 (representative image of N=5/group) shows that combined administration of dsRNA specific for TLR2 (i.e. TLR2__4__S73), at a dose of 25 µg/mouse and dsRNA specific for TLR4 (i.e. TLR4__4__S500), at a dose of 25 µg/mouse, efficiently reduced pulmonary edema in this mouse model of lung transplantation. No apparent edema was observed in any of the lungs treated with combination of dsRNA for TLR2 and dsRNA for TLR4. Similar results were obtained with a combination of TLR2__7__S73 and TLR4__4__S500 (with a dose of 25 µg/mouse of each). Similar results were obtained with a dose of 12.5 µg/mouse of each of the TLR2 dsRNA compound and TLR4 dsRNA compound (TLR2__7__S73 and TLR4__4__S500), while obvious edema appeared in animals that were treated with vehicle or with dsRNA targeting EGFP).

Figure 2:
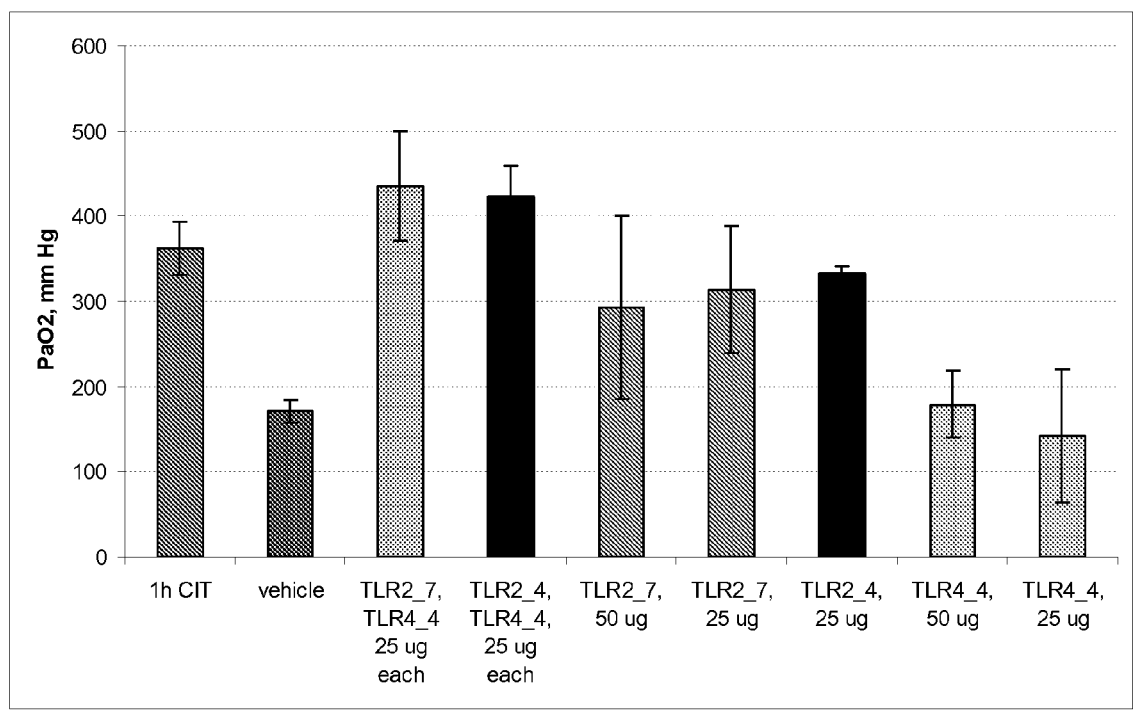
FIG. 2 shows that dual target dsRNA combination, targeting TLR2 and TLR4 genes z93rd and $4^{th}$ columns), restored pulmonary function in the recipient's lung. Oxygenation of the arterial blood in mice was measured at 24 h after lung transplantation and dsRNA administration. Administration of a single dsRNA targeting TLR2 ($5^{th}$ and $6^{th}$ columns), was also significantly effective in preserving pulmonary function.

FIG. 2 shows that impaired recipient pulmonary function, measured at 24 hours after lung transplantation, was restored in mice treated with a combination of dsRNA specific for TLR2 and dsRNA specific for TLR4, as well as in mice treated with a single dsRNA specific for TLR2, but not in mice treated with a single dsRNA directed at TLR4.

Two combinations of dsRNA specific for TLR2 and dsRNA specific for TLR4 were tested in these experiments, at a ratio of 1:1:

(ii) a combination of 25 µg/mouse of each TLR2__7__S73 and TLR4__4__S500, total therapeutic amount: 50 µg/mouse; and (iii) a combination of 25 µg/mouse of each TLR2__4__S73 and TLR4__4__S500, total therapeutic amount: 50 µg/mouse; and Additional animal groups were tested with either individual dsRNA specific for TLR2 or with an individual dsRNA specific for TLR4.

Two dsRNAs specific for TLR2 were tested in the experiments: TLR2__4__S73 at a dose of 25 µg/mouse and TLR2__7__S73 at doses of 25 µg/mouse and 50 µg/mouse.

One dsRNAs specific for TLR4 was tested in the experiments: TLR4__4__S500 at doses of 25 µg/mouse and 50 µg/mouse.

Negative control animals were treated with vehicle.

The test article (composition comprising a combination of dsRNA TLR2 and TLR4 dsRNA; dsRNA specific for TLR2;

dsRNA specific for TLR4; or vehicle) was administered immediately after opening of anastomosis and beginning of reperfusion.

FIG. 2 shows that administration of dual target dsRNA composition (comprising TLR2__7_S73 and TLR4__4_S500 (N=5) or TLR2__4_S73 and TLR4__4_S500 (N=3)), at a dose of 25 μg/mouse of each of the dsRNA compounds, significantly preserved pulmonary function, keeping blood oxygenation at almost normal levels (PaO2=500-530 mm Hg).

Administration of a single dsRNA compound specifically targeting TLR2 (TLR2__7_S73 (N=3) or TLR2__4_S73 (N=5)), at a dose of 25 μg/mouse of the individual dsRNA compound, was also significantly effective in preserving pulmonary function, keeping blood oxygenation at a level similar to the level obtained for 1 hour CIT control group. Similar results were obtained with a higher dose (50 μg/mouse) of a single dsRNA compound specifically targeting TLR2 (TLR2__7_S73; (N=5)).

Significantly, similar results were obtained with two different dsRNA TLR2 compounds (TLR2__7_S73 and TLR2__4_S73) that target different regions of the TLR2 gene.

Administration of a single dsRNA compound specifically targeting TLR4 (TLR4__4_S500), at doses of 25 μg/mouse (N=2) or 50 μg/mouse (N=3), was not effective in preserving pulmonary function, keeping blood oxygenation at a level similar to the level obtained for the vehicle control group.

FIG. 3 shows that impaired recipient pulmonary function, measured at 24 hours after lung transplantation, was restored in mice treated with a combination of dsRNA specific for TLR2 and dsRNA specific for TLR4 (identified in FIG. 3 as "siRNA cocktail"). A combination of TLR2__7_S73 and TLR4__4_S500 was used in these experiments, at a ratio of 1:1. Three doses were tested:
  (i) a combination of 25 μg/mouse of each TLR2__7_S73 and TLR4__4_S500, total therapeutic amount: 50 μg/mouse;
  (ii) a combination of 12.5 μg/mouse of each TLR2__7_S73 and TLR4__4_S500, total therapeutic amount: 25 μg/mouse; and
  (iii) a combination of 6 μg/mouse of each TLR2__7_S73 and TLR4__4_S500, total therapeutic amount: 12 μg/mouse Negative control animals were treated with vehicle or with dsRNA specific for EGFP (EGFP__5_S763) at a dose of 50 μg/mouse, 25 μg/mouse or 12.5 μg/mouse.

The test article (composition comprising a combination of TLR2 dsRNA and TLR4 dsRNA; or vehicle; or dsRNA specific for EGFP (identified in FIG. 3 as "control siRNA")) was administered immediately after opening of anastomosis and beginning of reperfusion.

FIG. 3 shows that following lung transplantation after 1 h of cold graft preservation (a reperfusion control), pulmonary function is only slightly worsened (PaO2=363±31 mm Hg), however, prolongation of cold preservation time (18 h CIT) leads to a dramatic reduction in recipient's pulmonary function (PaO2=170±13 mm Hg for vehicle group), indicating severe PGD (grade 3; ISHLT definition). Administration of dual target siRNA composition (comprising TLR2__7_S73 and TLR4__4_S500), at a dose of 25 μg/mouse of each of the dsRNA compounds, significantly (P<0.005) preserved pulmonary function (PaO2=435±64), keeping blood oxygenation at almost normal levels (PaO2=500-530 mm Hg). Administration of the same doses of non-targeting control dsRNA (EGFP__5_S763 at a dose of 50 μg/mouse) did not improve pulmonary function.

Administration of dual target dsRNA composition (comprising TLR2__7_S73 and TLR4__4_S500), at a dose of 12.5 μg/mouse of each of the dsRNA compounds, was also significantly effective (P<0.05) in preserving pulmonary function, keeping blood oxygenation at a level similar to the level obtained for 1 hour CIT control group. Administration of the same doses of non-targeting control dsRNA (EGFP__5_S763 at a dose of 25 μg/mouse) did not improve pulmonary function.

Administration of dual target dsRNA composition (comprising TLR2__7_S73 and TLR4__4_S500), at a dose of 6 μg/mouse of each of the dsRNA compounds, was not effective in preserving pulmonary function, keeping blood oxygenation at a level similar to the level obtained with vehicle and non-targeting control dsRNA (EGFP__5_S763 at a doses of 50 μg/mouse, 25 μg/mouse and 12.5 μg/mouse), which did not improve pulmonary function.

FIG. 4 shows that a combination of dsRNA specific for TLR2 and dsRNA specific for TLR4 (TLR2__4_S73 and TLR4__4_S500), as well as an individual treatment comprising dsRNA specific for TLR2 (TLR2__4_S73), diminished intra-airway accumulation of granulocytes. One of the pathophysiological features of PGD is rapid influx of cellular infiltrates to the interstitial lung space, which is typically detected in patients' chest radiographs. Consistent with this, total bronchoalveolar lavage (BAL) cell counts in mice that underwent lung transplantation after 18 h of CIT (vehicle group), were significantly (P<0.01) higher than those in mice that underwent lung transplantation after 1 h of CIT (24±6 vs 9±4 cells×10^5/lung respectively) (N=2). Treatment with a combination of dsRNA specific for TLR2 and dsRNA specific for TLR4 (TLR2__4_S73 and TLR4__4_S500; (N=5)), at a dose of 25 μg/mouse of each of the dsRNA compounds, as well as an individual treatment comprising dsRNA specific for TLR2 (TLR2__4_S73), at a doses of 50 μg/mouse (N=2) or at a dose of 25 μg/mouse (N=5), diminished cellular BAL infiltration associated with prolonged cold preservation. Moreover, treatment with a combination of dsRNA specific for TLR2 and dsRNA specific for TLR4, as well as an individual treatment comprising dsRNA specific for TLR2, diminished granulocyte (neutrophils, eosinophils, basophils) accumulation in the lung airways.

Administration of a single dsRNA compound specifically targeting TLR4 (TLR4__4_S500), at a dose of 50 μg/mouse (N=2), was not effective in diminishing intra-airway accumulation of granulocytes, keeping intra-airway accumulation of granulocytes at a level similar to the level obtained with vehicle and non-targeting control dsRNA (EGFP__5_S763) at a dose of 50 μg/mouse (N=2), 25 μg/mouse (N=5) or 12.5 μg/mouse (N=5).

Mouse Allogeneic Lung Transplantation (Balb/C-> C57B1/6)

Experimental Design

In this model prolonged cold ischemia prevents lung allograft acceptance mediated by immunosuppression. In this model Balb/c lungs are subjected to 18 hours of cold ischemia time (CIT) and are transplanted into C57B1/6 recipients that are treated with immunosuppressants: anti-CD40L on post operative day 0 and CTLA4Ig on day 2. In contrast to recipients who received allografts stored for 1 hour, these stored for 18 hours acutely rejected their allografts with marked intragraft accumulation of IFNγ+ CD8' T cells.

Evaluation

Lung recipients were evaluated at 7 days post transplantation through assessing:
  Abundance of intragraft IFNγ+ CD8+ T cells (by FACS)
  Histopathological signs of acute graft rejection, A score Administration By intratracheal instillation of dsRNA solution to the lungs; 2 doses of a dsRNA compound or of a combination of dsRNA compounds are administered immediately after anastomosis opening on Day 0 and on Day 1 post lung transplantation.

Results

Administration of a combination of a dsRNA specific for TLR2 and dsRNA specific for TLR4 (TLR2_4_S73 and TLR4_4_S500, identified as "siRNA cocktail") with a dose of 25 μg/mouse of each of the dsRNA compounds (N=5), or of a single dsRNA specific for TLR2 (TLR2_4_S73), at a dose of 25 μg/mouse (N=4), diminished abundance of intragraft IFNγ+ CD8+ T cells in allo-transplantation. In this allogeneic model, in prolonged cold ischemia prevents lung allograft acceptance mediated by immunosuppression. In this model Balb/c lungs are subjected to 18 hours (18 CIT) of cold ischemia and are transplanted into C57BL/6 (B6) recipients that are treated with anti-CD40L on postoperative day (POD) 0 and CTLA4Ig on POD 2. Both of these immunosuppressive reagents are currently in pre-clinic development by major pharmaceutical companies and when used together are generally referred to as double costimulatory blockade treatment (DCB). In contrast to recipients who received allografts stored for 1 hour (1 CIT) (N=6-), 18 CIT Balb/c->DCB+B6 lung recipients (N=6) acutely rejected their allografts with marked intragraft accumulation of IFNγ+ CD8+ T (FIG. 5 A, upper panel). This rejection was also evident by histopathological evaluation (FIG. 6 A,B).

In this model, control dsRNA (EGFP_5_S763) treated lung recipients (N=3) acutely rejected their allografts with significantly elevated IFNγ+ CD8+ T cells accumulation in allograft tissue. By contrast, recipient mice treated with a combination of a dsRNA specific for TLR2 and dsRNA specific for TLR4 (TLR2_4_S73 and TLR4_4_S500, identified as "siRNA cocktail"; (N=5)) on days 0 and 1, had significantly decreased abundance of intragraft IFNγ$^+$ CD8$^+$ T cells (FIG. 5 A, B), as well as significantly less histological evidence of acute rejection (FIG. 6 A, B).

These experiments show that targeting TLR function using dsRNA compounds specific for TLR2 or a combination of dsRNA compounds specific for TLR2 and TLR4 significantly improves/prevents lung graft injury. Lung function in TLR2 or TLR2- and TLR4-dsRNA treated recipients was similar to lung recipients of 1 hour cold preserved graft, indicating that this method may be useful in preventing/treating primary graft dysfunction in lung transplant recipients. These experimental procedures and dsRNA treatments may be conducted in major histocompatibility complex (MHC)-mismatched donors and recipients.

Example 5 dsRNA Oligonucleotide Sense and Antisense Pairs

The Sequence Listing provides sense and antisense oligonucleotides for generating double-stranded oligonucleotide compounds, useful in carrying out the methods disclosed herein.

The sense and antisense strands of the TLR2 double-stranded oligonucleotides are provided in sense strand sequences set forth in SEQ ID NOs: 5-722; 1441-2246; 3053-4152; and 5253-5545 and antisense strand sequences set forth in SEQ ID NOs: 723-1440; 2247-3052; 4153-5252 and 5546-5838.

The sense and antisense strands of the TLR4 double-stranded oligonucleotides are provided in sense strand sequences set forth in SEQ ID NOs: 5839-7075, 8313-8458, 8605-10318, 12033-12084 and antisense strand sequences set forth in SEQ ID NOs: 7076-8312, 8459-8604, 10319-12032, 12085-12136.

The contents of the articles, patents, and patent applications, and all other documents and electronically available information mentioned or cited herein, are hereby incorporated by reference in their entirety to the same extent as if each individual publication was specifically and individually indicated to be incorporated by reference.

Applicants reserve the right to physically incorporate into this application any and all materials and information from any such articles, patents, patent applications, or other physical and electronic documents.

It will be readily apparent to one skilled in the art that varying substitutions and modifications can be made to the invention disclosed herein without departing from the scope and spirit of the invention. Thus, such additional embodiments are within the scope of the present invention and the following claims. The present disclosures teach one skilled in the art to test various combinations described herein toward generating therapeutic combination with improved activity for treating lung disorders or injury in a mammal. Such improved activity can include e.g., improved stability, improved bioavailability, improved activation of cellular responses mediating RNAi. Therefore, the specific embodiments described herein are not limiting and one skilled in the art can readily appreciate that additional specific combinations can be tested without undue experimentation toward identifying therapeutic combinations with improved activity.

The inventions illustratively described herein may suitably be practiced in the absence of any element or elements, limitation or limitations, not specifically disclosed herein. Thus, for example, the terms "a" and "an" and "the" and similar referents in the context of describing the invention (especially in the context of the following claims) are to be construed to cover both the singular and the plural, unless otherwise indicated herein or clearly contradicted by context. The terms "comprising", "having," "including," containing", etc. shall be read expansively and without limitation (e.g., meaning "including, but not limited to,"). Recitation of ranges of values herein are merely intended to serve as a shorthand method of referring individually to each separate value falling within the range, unless otherwise indicated herein, and each separate value is incorporated into the specification as if it were individually recited herein. All methods described herein can be performed in any suitable order unless otherwise indicated herein or otherwise clearly contradicted by context. The use of any and all examples, or exemplary language (e.g., "such as") provided herein, is intended merely to better illuminate the invention and does not pose a limitation on the scope of the invention unless otherwise claimed. No language in the specification should be construed as indicating any non-claimed element as essential to the practice of the invention. Additionally, the terms and expressions employed herein have been used as terms of description and not of limitation, and there is no intention in the use of such terms and expressions of excluding any equivalents of the features shown and described or portions thereof, but it is recognized that various modifications are possible within the scope of the invention claimed. Thus, it should be understood that although the present invention has been specifically disclosed by preferred embodiments and optional features, modification and variation of the inventions embodied therein herein disclosed may be resorted to by those skilled in the art, and that such modifications and variations are considered to be within the scope of this invention.

The invention has been described broadly and generically herein. Each of the narrower species and sub-generic groupings falling within the generic disclosure also form part of the invention. This includes the generic description of the invention with a proviso or negative limitation removing any subject matter from the genus, regardless of whether or not the excised material is specifically recited herein. Other embodiments are within the following claims. In addition, where features or aspects of the invention are described in terms of Markush groups, those skilled in the art will recognize that the invention is also thereby described in terms of any individual member or subgroup of members of the Markush group.

SEQUENCE LISTING (12136 sequences)

SEQ ID NO: 1 - RNA, 3417 nt, Homo sapiens
cggaggcagcgagaaagcgcagccaggcggcugcucggcguucucucaggugacugcucggaguucucccaguguuugguguugcaagcaggauccaaaggagaccuauagugacucccaggagcucuuagugaccaagugaagguaccuguggggcucauugugcccauugcucuuucacugcuuucaacugguaguuguggguugaagcacuggacaaugccacauacuuuguggauggugugggucuugggggucaucaucagccucuccaaggaagaauccuccaaucaggcuucucugucuugugaccgcaaugguaucugcaagggcagcucaggaucuuuaaacuccauucccucagggcucacagaagcuguaaaaagccuugaccuguccaacaacaggaucaccuacauuagcaacagugaccuacagaggugugugaaccuccaggcucuggugcugacauccaauggaauuaacacaauagaggaagauucuuuuucuucccugggcagucuugaacauuuagacuuauccuauaauuacuuaucuaauuuaucgucuuccugguucaagccccuuucuucuuuaacauucuuaaacuuacugggaaauccuuacaaaacccuaggggaaacaucucuuuuuucucaucucacaaaauugcaaauccugagagugggaaauauggacaccuucacuaagauucaaagaaaagauuuugcuggacuuaccuuccuugaggaacuugagauugaugcuucagaucuacagagcuaugagccaaaaaguuugaagucaauucagaauguaagucaucugauccuucauaugaagcagcauauuuuacugcuggagauuuuuguagauguuacaaguuccguggaauguuuggaacugcgagauacugauuuggacacuuuccauuuuucagaacuauccacuggugaaacaaauucauugauuaaaaaguuuacauuuagaaaugugaaaaucaccgaugaaaguuuguuucagguuaugaaacuuuugaaucagauuucuggauuguuagaauuagaguuugaugacuguacccuuaauggaguugguaauuuuagagcaucugauaaugacagaguuauagauccagguaaaguggaaacguuaacaauccggaggcugcauauuccaagguuuuacuuauuuuaugaucugagcacuuuauauucacuuacagaaagaguuaaaagaaucacaguagaaaacaguaaaguuuuucugguuccuuguuuacuuucacaacauuuaaaaucauuagaauacuuggaucucagugaaaauuugaugguugaagaauacuugaaaaauucagccugugaggaugccuggcccucucuacaaacuuuaauuuuaaggcaaaaucauuuggcaucauuggaaaaaaccggagagacuuugcucacucugaaaaacuugacuaacauugauaucaguaagaauaguuuucauucuaugccugaaacuugucaguggccagaaaagaugaaauauuugaacuuauccagcacacgaauacacaguguaacaggcugcauucccaagacacuggaaauuuuagauguuagcaacaacaaucucaauuuauuuucuuugaauuugccgcaacucaaagaacuuuauauuuccagaaauaaguugaugacucuaccagaugccucccucuuacccauguuacuaguauugaaaaucaguaggaaugcaauaacuacguuuucuaaggagcaacuugacucauuucacacacugaagacuuuggaagcugguggcaauaacuucauuugcuccugugaauuccucuccuucacucaggagcagcaagcacuggccaaagucuugauugauuggccagcaaauuaccugugugacucuccaucccaugugcguggccagcagguucaggauguccgccucucggugucggaaugucacaggacagcacuggugucuggcaugugcugugcucuguuccugcugauccugcucacggggguccugugccaccguuuccauggccugugguauaugaaaaugaugugggccuggcuccaggccaaaaggaagcccaggaaagcucccagcaggaacaucugcuaugaugcauuuguuucuuacagugagcgggaugccuacuggguggagaaccuuaugguccaggagcuggagaacuucaauccccccuucaaguugugucuucauaagcgggacuucauuccuggcaaguggaucauugacaauaucauugacuccauugaaaagagccacaaaacugucuuugugcuuucugaaaacuuugugaagagugaguggugcaaguaugaacuggacuucucccauuuccgucuuuuugaugagaacaaugaugcugccauucucauucuucuggagcccauugagaaaaaagccauuccccagcgcuucugcaagcugcggaagauaaugaacaccaagaccuaccuggaguggcccauggacgaggcucagcgggaaggauuuuggguaaaucugagagcugcgauaaaguccuagguucccauauuuaagaccagucuuugucuaguugggaucuuuaugucacuaguuauaguuaaguucauucagacauaauuauauaaaaacuacguggauguaccgucauuugaggacuugcuuacuaaaacuacaaaacuucaaauuuugucuggggugcuguuuuauaaacauaugccagauuuaaaaauugguuuuugguuuuucuuuuuucuaugagauaaccaugaucauaagucuauuacugauaucugaauauagucccuugguauccaagggaauugguugcaggauccucguggauaucaaaauucauagaugaucaagucccuuauaagaguggcauaguauuugcauauaaccuguguacauucuccuguauacuuuaaaucaucucuagauuacuuaugauacccaauacaauguaaauacuauguaaauaguuguacugucuuuuuauuuauauuauuauuguuauuuuuuauuuucaaaauuuuuaaaacauacuuuugauccacaguugguugacuucauggaugcagaacccauggauauagagggccaacuguaaucuguagcaacuggcuuaguucauuaggaaacagcacaaaugaacuuaagauucucaaugacugugucauucuuucuuccugcuaagagacuccucuguggccacaaaaggcauucucuguccuaccuagcugucacuucucugugcagcugaucucaagagcaacaaggcaaaguauuuggggcacuccccaaaacuuguugcuauuccuagaaaaaagugcuguguauuuccuauuaaacuuuacaggaugagaaaaaaaaaaaaaaaaa

SEQ ID NO: 2 - RNA, 5500 nt, Homo sapiens
cucuugcuguuucuuuagccacuggucugcaggcguuuucuucuucuaacuuccucuccugugacaaaagagauaacuauuagagaaacaaaaguccagaaugcuaagguugccgcuuucacuuccucucacccuuuagcccagaacugcuuugaauacaccaauugcuguggggcggcucgaggaagagaagacaccagugccucagaaacugcucggucagacggugauagcgagccacgcauucacagggccacugcugcucacagaagcagugaggaugaugccaggaugaugucugccucgcgccuggcugggacucugaucccagccauggccuuccucuccugcgugagaccagaaagcugggagcccugcguggaggugugaaauccagacaauugaagauggggcauaucagagccuaagccaccucucuaccuuaauauugacaggaaaccccauccagaguuuagcccugggagccuuuucuggacuaucaaguuuacagaagcugguggcuguggagacaaaucuagcaucucuagagaacuuccccauuggacaucucaaaacuuugaaagaacuuaauguggcucacaaucuuauccaaucuuucaaauuaccugaguauuuuucuaaucugaccaaucuagagcacuuggaccuuuccagcaacaagauucaaaguauuuauugcacagacuugcggguucuacaucaaaugccccuacucaaucucucuuuagaccugucccugaacccuaugaacuuuauccaaccaggugcauuuaaagaaauuaggcuucauaagcugacuuuaagaaauaauuuugauaguuuaaauguaaugaaaacuuguauucaaggucuggcugguuuagaaguccaucguuugguucugggagaauuuagaaaugaaggaaacuuggaaaaguuugacaaaucugcucuagagggccugugcaauuugaccauugaagaauuccgauuagcauacuuagacuacuaccucgaugauauuauugacuuauuuaauuguuugacaaauguuucuucauuuucccuggugagugugacuauugaaaggguaaaagacuuuucuuauaauuucggauggcaacauuuagaauuaguuaacuguaaauuuggacaguuucccacauugaaacucaaaucucucaaaaggcuuacuuucacuuccaacaaaggugggaaugcuuuuucagaaguugaucuaccaagccuugaguuucuagaucucaguagaaauggcuugaguuucaaagguugcuguucucaaagugauuuugggacaaccagccuaaaguauuuagaucugagcuucaaugguguuauuaccaugaguucaaacuucuugggcuuagaacaacuagaacaucuggauuuccagcauuccaauuugaaacaaaugagugaguuuucaguauuccuaucacucagaaaccucauuuaccuugacauuucucauacucacaccagaguugcuuucaauggcaucuucaauggcuuguccagucucgaagucuugaaaauggcuggcaauucuuuccaggaaaacuuccuuccagauaucuucacagagcugagaaacuugaccuuccuggaccucucucagugucaacuggagcaguugucuccaacagcauuuaacucacucuccagucuucagguacuaaauaugagccacaacaacuucuuuucauuggauacguuuccuuauaagugucugaacucccuccagguucuugauuacagucucaaucacauaaugacuuccaaaaaacaggaacuacagcauuuuccaaguagucuagcuuucuuaaaucuuacucagaaugacuuugcuuguacuugugaacaccagaguuuccugcaauggaucaaggaccagaggcagcucuugguggaaguugaacgaauggaaugugcaacaccuucagauaagcagggcaugccugugcugaguuugaauaucaccugucagaugaauaagaccaucauuggugugucgguccucagugugcuuguaguaucuguuguagcaguucuggucuauaaguucuauuuucaccugaugcuucuugcuggcugcauaaaguaugguagaggugaaaacaucuaugaugccuuuguuaucuacucaagccaggaugaggacuggguaaggaaugagcuaguaaagaauuuagaagaaggggugccuccauuucagcucugccuucacuacagagacuuuauucccgguguggccauugcugccaacaucauccaugaagguuuccauaaaagccgaaaggugauuguuguggugucccagcacuucauccagagccgcugguguaucuuugaauaugagauugcucagaccuggcaguuucugagcagucgugcugguaucaucuucauuguccugcagaagguggagaagacccugcucaggcagcagguggagcuguaccgccuucucagcaggaacacuuaccuggagugggaggacaguguccuggggcggcacaucuucuggagacgacucagaaaagcccugcuggaugguaaaucauggaauccagaaggaacaguggguacaggaugcaauuggcaggaagcaacaucuaucugaagaggaaaaauaaaaaccuccugaggcauuucuugcccagcuggguccaacacuuguucaguuaauaaguauuaaaugcugccacaugucaggccuuaugcuaagggugaguaauuccauggugcacuagauaugcagggcugcuaaucucaaggagcuuccagugcagagggaauaaaugcuagacuaaaauacagagucuuccaggugggcauuucaaccaacucagucaaggaacccaugacaaagaaagucauuucaacucuuaccucaucaaguugaauaaagacagagaaaacagaaagagacauuguucuuuuccugagucuuuugaauggaaauuguauuauguuauagccaucauaaaaccauuuugguaguuuugacugaacuggguguucacuuuuuccuuuuugauugaauacaauuuaaauucuacuugaugacugcagucgucaaggggcuccugaugcaagaugccccuuccauuuuaagucugucuccuuacagagguuaaagucuaguggcuaauuccuaaggaaaccugauuaacacaugcucacaaccauccuggucauucucgagcauguucuauuuuuuaacuaaucaccccugauauauuuuuauuuuuauauauccaguuuucauuuuuuuacgucuugccuauaagcuaauaucauaaauaagguuguuuaagacgugcuucaaauauccauauuaaccacuauuuuucaaggaaguauggaaaaguacacucugucacuuugucacucgaugucauuccaaaguuauugccuacuaaguaaugacugucaugaaagcagcauugaaauaauuuguuuaaagggggcacucuuuuaaacgggaagaaaauuuccgcuuccuggucuuaucauggacaauuugggcuagaggcaggaaggaagugggaugaccucaggaggucaccuuuucuugauuccagaaacauaugggcugauaaacccggggugaccucaugaaaugaguugcagcagaaguuuauuuuuuucagaacaagugauguuugauggaccucugaaucucuuuagggagacacagauggcugggaucccuccccuguacccuucucacugccaggagaacuacgugugaagguauucaaggcagggaguauacauugcuguuuccuguugggcaaugcuccuugaccacauuuugggaagaguggauguuaucauugagaaaacaaugugucuggaauuaaugggguucuuauaaagaagguucccagaaaagaauguucauccagccuccucagaaacagaacauucaagaaaaggacaaucaggaugucaucagggaaaugaaaauaaaaaccacaaugagauaucaccuuauaccagguagaauggcuacuauaaaaaaaugaagugucaucaaggauauagagaaauuggaacccuucuucacugcuggagggaauggaaaaugguguagccguuaugaaaaacaguacggagguuucucaaaaauuaaaaauagaacugcuauaugauccagcaaucucacuucuguauauauacccaaaauaauugaaaucagaauuucaagaaaauauuuacacucccauguucauuguggcacucuucacaaucacuguuuccaaaguuauggaaacaacccaaauuuccauugaaaaauaaauggacaaagaaaaugugcauauacguacaaugggauauuauucagccuaaaaaaagggggaauccuguuauuuaugacaacaugaauaaacccggaggccauuaugcuauguaaaaugagcaaguaacagaaagacaaauacugccugauuucauuuauaugagguucuaaaauagucaaacucauagaagcagagaauagaacagugguuccuagggaaaaggaggaagggagaaaugaggaaauagggaguugucuaauugguauaaaauuauaguaugcaagaugaauuagcucuaaagaucagcuguauagcagaguucguauaaugaacaauacuguauuaugcacuuaacauuuuguuaagaggguaccucucauguuaaguguucuuaccauauacauauacacaaggaagcuuuuggaggugauggauauauuuauuaccuugauuguggugaugguuugacagguaugugacuaugucuaaacucaucaaauuguauacauuaaauauaugcaguuuuauaauaucaauuaugucugaaugaagcuauaaaaaagaaaagacaacaaaauucaguugucaaaacuggaaauaugaccacagucagaaguguuuguuacugaguguuucagaguguguuugguuugagcaggucuagggugauugaacaucccuggguguguuuccaugucucauguacuagugaaaguagaugugugcauuugugcacauaucccuauguaucccuaucagggcuguguguauuugaaaguguguguguccgcaugaucauaucuguauagaagagagugugauuauauuucuugaagaauacauccauuugaaauggaugucuauggcuguuugagaugaguucucuacucuugugcuuguacaguagucuccccuuaucccuuaugcuugguggauacguucuuagaccccaaguggaucucugagaccgcagaugguaccaaaccucauauaugcaauauuuuuuccuauacauaaauaccuaagauaaaguucaucuucugaauuaggcacaguaagagauuaacaauaacuaacaauaaaauugaauaguuauaauaauauauuguaauaaaaguuaugugaaugugaucucuuucuuucucucucucaaaaaaaaaaaaaaaaaa

SEQ ID NO: 3 - RNA, 5667 nt, Homo sapiens
cucuugcuguuucuuuagccacuggucugcaggcguuuucuucuucuaacuuccucuccugugacaaaagagauaacuauuagagaaacaaaaguccagaaugcuaagguugccgcuuucacuuccucucacccuuuagcccagaacugcuuugaauacaccaauugcuguggggcggcucgaggaagagaagacaccagugccucagaaacugcucggucagacggugauagcgagccacgcauucacagggccacugcugcucacagaagcagugaggaugaugccaggaugaugucugccucgcgccuggcugggacucugaucccagccauggccuuccucuccugcgugagaccagaaagcugggagcccugcguggaggugguuccuaauauuacuuaucaaugcauggagcugaauuucuacaaaauccccgacaaccuccccuucucaaccaagaaccuggaccugagcuuuaauccccugaggcauuuaggcagcuauagcuucuucaguuucccagaacugcaggugcuggauuuauccaggugugaaauccagacaauugaagauggggcauaucagagccuaagccaccucucuaccuuaauauugacaggaaaccccauccagaguuuagcccugggagccuuuucuggacuaucaaguuuacagaagcugguggcuguggagacaaaucuagcaucucuagagaacuuccccauuggacaucucaaaacuuugaaagaacuuaauguggcucacaaucuuauccaaucuuucaaauuaccugaguauuuuucuaaucugaccaaucuagagcacuuggaccuuuccagcaacaagauucaaaguauuuauugcacagacuugcggguucuacaucaaaugccccuacucaaucucucuuuagaccugucccugaacccuaugaacuuuauccaaccaggugcauuuaaagaaauuaggcuucauaagcugacuuuaagaaauaauuuugauaguuuaaauguaaugaaaacuuguauucaaggucuggcugguuuagaaguccaucguuugguucugggagaauuuagaaaugaaggaaacuuggaaaaguuugacaaaucugcucuagagggccugugcaauuugaccauugaagaauuccgauuagcauacuuagacuacuaccucgaugauauuauugacuuauuuaauuguuugacaaauguuucuucauuuucccuggugagugugacuauugaaaggguaaaagacuuuucuuauaauuucggauggcaacauuuagaauuaguuaacuguaaauuuggacaguuucccacauugaaacucaaaucucucaaaaggcuuacuuucacuuccaacaaaggugggaaugcuuuuucagaaguugaucuaccaagccuugaguuucuagaucucaguagaaauggcuugaguuucaaagguugcuguucucaaagugauuuugggacaaccagccuaaaguauuuagaucugagcuucaaugguguuauuaccaugaguucaaacuucuugggcuuagaacaacuagaacaucuggauuuccagcauuccaauuugaaacaaaugagugaguuuucaguauuccuaucacucagaaaccucauuuaccuugacauuucucauacucacaccagaguugcuuucaauggcaucuucaauggcuuguccagucucgaagucuugaaaauggcuggcaauucuuuccaggaaaacuuccuuccagauaucuucacagagcugagaaacuugaccuuccuggaccucucucagugucaacuggagcaguugucuccaacagcauuuaacucacucuccagucuucagguacuaaauaugagccacaacaacuucuuuucauuggauacguuuccuuauaagugucugaacucccuccagguucuugauuacagucucaaucacauaaugacuuccaaaaaacaggaacuacagcauuuuccaaguagucuagcuuucuuaaaucuuacucagaaugacuuugcuuguacuugugaacaccagaguuuccugcaauggaucaaggaccagaggcagcucuugguggaaguugaacgaauggaaugugcaacaccuucagauaagcagggcaugccugugcugaguuugaauaucaccugucagaugaauaagaccaucauuggugugucgguccucagugugcuuguaguaucuguuguagcaguucuggucuauaaguucuauuuucaccugaugcuucuugcuggcugcauaaaguaugguagaggugaaaacaucuaugaugccuuuguuaucuacucaagccaggaugaggacuggguaaggaaugagcuaguaaagaauuuagaagaaggggugccuccauuucagcucugccuucacuacagagacuuuauucccgguguggccauugcugccaacaucauccaugaagguuuccauaaaagccgaaaggugauuguuguggugucccagcacuucauccagagccgcugguguaucuuugaauaugagauugcucagaccuggcaguuucugagcagucgugcugguaucaucuucauuguccugcagaagguggagaagacccugcucaggcagcagguggagcuguaccgccuucucagcaggaacacuuaccuggagugggaggacaguguccuggggcggcacaucuucuggagacgacucagaaaagcccugcuggaugguaaaucauggaauccagaaggaacaguggguacaggaugcaauuggcaggaagcaacaucuaucugaagaggaaaaauaaaaaccuccugaggcauuucuugcccagcuggguccaacacuuguucaguuaauaaguauuaaaugcugccacaugucaggccuuaugcuaagggugaguaauuccauggugcacuagauaugcagggcugcuaaucucaaggagcuuccagugcagagggaauaaaugcuagacuaaaauacagagucuuccaggugggcauuucaaccaacucagucaaggaacccaugacaaagaaagucauuucaacucuuaccucaucaaguugaauaaagacagagaaaacagaaagagacauuguucuuuuccugagucuuuugaauggaaauuguauuauguuauagccaucauaaaaccauuuugguaguuuugacugaacuggguguucacuuuuuccuuuuugauugaauacaauuuaaauucuacuugaugacugcagucgucaaggggcuccugaugcaagaugccccuuccauuuuaagucugucuccuuacagagguuaaagucuaguggcuaauuccuaaggaaaccugauuaacacaugcucacaaccauccuggucauucucgagcauguucuauuuuuuaacuaaucaccccugauauauuuuuauuuuuauauauccaguuuucauuuuuuuacgucuugccuauaagcuaauaucauaaauaagguuguuuaagacgugcuucaaauauccauauuaaccacuauuuuucaaggaaguauggaaaaguacacucugucacuuugucacucgaugucauuccaaaguuauugccuacuaaguaaugacugucaugaaagcagcauugaaauaauuuguuuaaagggggcacucuuuuaaacgggaagaaaauuuccgcuuccuggucuuaucauggacaauuugggcuagaggcaggaaggaagugggaugaccucaggaggucaccuuuucuugauuccagaaacauaugggcugauaaacccggggugaccucaugaaaugaguugcagcagaaguuuauuuuuuucagaacaagugauguuugauggaccucugaaucucuuuagggagacacagauggcugggaucccuccccuguacccuucucacugccaggagaacuacgugugaagguauucaaggcagggaguauacauugcuguuuccuguugggcaaugcuccuugaccacauuuugggaagaguggauguuaucauugagaaaacaaugugucuggaauuaaugggguucuuauaaagaagguucccagaaaagaauguucauccagccuccucagaaacagaacauucaagaaaaggacaaucaggaugucaucagggaaaugaaaauaaaaaccacaaugagauaucaccuuauaccagguagaauggcuacuauaaaaaaaugaagugucaucaaggauauagagaaauuggaacccuucuucacugcuggagggaauggaaaaugguguagccguuaugaaaaacaguacggagguuucucaaaaauuaaaaauagaacugcuauaugauccagcaaucucacuucuguauauauacccaaaauaauugaaaucagaauuucaagaaaauauuuacacucccauguucauuguggcacucuucacaaucacuguuuccaaaguuauggaaacaacccaaauuuccauugaaaaauaaauggacaaagaaaaugugcauauacguacaaugggauauuauucagccuaaaaaaagggggaauccuguuauuuaugacaacaugaauaaacccggaggccauuaugcuauguaaaaugagcaaguaacagaaagacaaauacugccugauuucauuuauaugagguucuaaaauagucaaacucauagaagcagagaauagaacagugguuccuagggaaaaggaggaagggagaaaugaggaaauagggaguugucuaauugguauaaaauuauaguaugcaagaugaauuagcucuaaagaucagcuguauagcagaguucguauaaugaacaauacuguauuaugcacuuaacauuuuguuaagaggguaccucucauguuaaguguucuuaccauauacauauacacaaggaagcuuuuggaggugauggauauauuuauuaccuugauuguggugaugguuugacagguaugugacuaugucuaaacucaucaaauuguauacauuaaauauaugcaguuuuauaauaucaauuaugucugaaugaagcuauaaaaaagaaaagacaacaaaauucaguugucaaaacuggaaauaugaccacagucagaaguguuuguuacugaguguuucagaguguguuugguuugagcaggucuagggugauugaacaucccuggguguguuuccaugucucauguacuagugaaaguagaugugugcauuugugcacauaucccuauguaucccuaucagggcuguguguauuugaaaguguguguguccgcaugaucauaucuguauagaagagagugugauuauauuucuugaagaauacauccauuugaaauggaugucuauggcuguuugagaugaguucucuacucuugugcuuguacaguagucuccccuuaucccuuaugcuugguggauacguucuuagaccccaaguggaucucugagaccgcagaugguaccaaaccucauauaugcaauauuuuuuccuauacauaaauaccuaagauaaaguucaucuucugaauuaggcacaguaagagauuaacaauaacuaacaauaaaauugaauaguuauaauaauauauuguaauaaaaguuaugugaaugugaucucuuucuuucucucucucaaaaaaaaaaaaaaaaaa

SEQ ID NO: 4 - RNA, 5787 nt, Homo sapiens
cucuugcuguuucuuuagccacuggucugcaggcguuuucuucuucuaacuuccucuccugugacaaaagagauaacuauuagagaaacaaaaguccagaaugcuaagguugccgcuuucacuuccucucacccuuuagcccagaacugcuuugaauacaccaauugcuguggggcggcucgaggaagagaagacaccagugccucagaaacugcucggucagacggugauagcgagccacgcauucacagggccacugcugcucacagaagcagugaggaugaugccaggaugaugucugccucgcgccuggcugggacucugaucccagccauggccuuccucuccugcgugagaccagaaagcugggagcccugcguggagacuuggcccuaaaccacacagaagagcuggcaugaaacccagagcuuucagacuccggagccucagcccuucaccccgauuccauugcuucuugcuaaaugcugccguuuuaucacggaggugguuccuaauauuacuuaucaaugcauggagcugaauuucuacaaaauccccgacaaccuccccuucucaaccaagaaccuggaccugagcuuuaauccccugaggcauuuaggcagcuauagcuucuucaguuucccagaacugcaggugcuggauuuauccaggugugaaauccagacaauugaagauggggcauaucagagccuaagccaccucucuaccuuaauauugacaggaaaccccauccagaguuuagcccugggagccuuuucuggacuaucaaguuuacagaagcugguggcuguggagacaaaucuagcaucucuagagaacuuccccauuggacaucucaaaacuuugaaagaacuuaauguggcucacaaucuuauccaaucuuucaaauuaccugaguauuuuucuaaucugaccaaucuagagcacuuggaccuuuccagcaacaagauucaaaguauuuauugcacagacuugcggguucuacaucaaaugccccuacucaaucucucuuuagaccugucccugaacccuaugaacuuuauccaaccaggugcauuuaaagaaauuaggcuucauaagcugacuuuaagaaauaauuuugauaguuuaaauguaaugaaaacuuguauucaaggucuggcugguuuagaaguccaucguuugguucugggagaauuuagaaaugaaggaaacuuggaaaaguuugacaaaucugcucuagagggccugugcaauuugaccauugaagaauuccgauuagcauacuuagacuacuaccucgaugauauuauugacuuauuuaauuguuugacaaauguuucuucauuuucccuggugagugugacuauugaaaggguaaaagacuuuucuuauaauuucggauggcaacauuuagaauuaguuaacuguaaauuuggacaguuucccacauugaaacucaaaucucucaaaaggcuuacuuucacuuccaacaaaggugggaaugcuuuuucagaaguugaucuaccaagccuugaguuucuagaucucaguagaaauggcuugaguuucaaagguugcuguucucaaagugauuuugggacaaccagccuaaaguauuuagaucugagcuucaaugguguuauuaccaugaguucaaacuucuugggcuuagaacaacuagaacaucuggauuuccagcauuccaauuugaaacaaaugagugaguuuucaguauuccuaucacucagaaaccucauuuaccuugacauuucucauacucacaccagaguugcuuucaauggcaucuucaauggcuuguccagucucgaagucuugaaaauggcuggcaauucuuuccaggaaaacuuccuuccagauaucuucacagagcugagaaacuugaccuuccuggaccucucucagugucaacuggagcaguugucuccaacagcauuuaacucacucuccagucuucagguacuaaauaugagccacaacaacuucuuuucauuggauacguuuccuuauaagugucugaacucccuccagguucuugauuacagucucaaucacauaaugacuuccaaaaaacaggaacuacagcauuuuccaaguagucuagcuuucuuaaaucuuacucagaaugacuuugcuuguacuugugaacaccagaguuuccugcaauggaucaaggaccagaggcagcucuugguggaaguugaacgaauggaaugugcaacaccuucagauaagcagggcaugccugugcugaguuugaauaucaccugucagaugaauaagaccaucauuggugugucgguccucagugugcuuguaguaucuguuguagcaguucuggucuauaaguucuauuuucaccugaugcuucuugcuggcugcauaaaguaugguagaggugaaaacaucuaugaugccuuuguuaucuacucaagccaggaugaggacuggguaaggaaugagcuaguaaagaauuuagaagaaggggugccuccauuucagcucugccuucacuacagagacuuuauucccgguguggccauugcugccaacaucauccaugaagguuuccauaaaagccgaaaggugauuguuguggugucccagcacuucauccagagccgcugguguaucuuugaauaugagauugcucagaccuggcaguuucugagcagucgugcugguaucaucuucauuguccugcagaagguggagaagacccugcucaggcagcagguggagcuguaccgccuucucagcaggaacacuuaccuggagugggaggacaguguccuggggcggcacaucuucuggagacgacucagaaaagcccugcuggaugguaaaucauggaauccagaaggaacaguggguacaggaugcaauuggcaggaagcaacaucuaucugaagaggaaaaauaaaaaccuccugaggcauuucuugcccagcuggguccaacacuuguucaguuaauaaguauuaaaugcugccacaugucaggccuuaugcuaagggugaguaauuccauggugcacuagauaugcagggcugcuaaucucaaggagcuuccagugcagagggaauaaaugcuagacuaaaauacagagucuuccaggugggcauuucaaccaacucagucaaggaacccaugacaaagaaagucauuucaacucuuaccucaucaaguugaauaaagacagagaaaacagaaagagacauuguucuuuuccugagucuuuugaauggaaauuguauuauguuauagccaucauaaaaccauuuugguaguuuugacugaacuggguguucacuuuuuccuuuuugauugaauacaauuuaaauucuacuugaugacugcagucgucaaggggcuccugaugcaagaugccccuuccauuuuaagucugucuccuuacagagguuaaagucuaguggcuaauuccuaaggaaaccugauuaacacaugcucacaaccauccuggucauucucgagcauguucuauuuuuuaacuaaucaccccugauauauuuuuauuuuuauauauccaguuuucauuuuuuuacgucuugccuauaagcuaauaucauaaauaagguuguuuaagacgugcuucaaauauccauauuaaccacuauuuuucaaggaaguauggaaaaguacacucugucacuuugucacucgaugucauuccaaaguuauugccuacuaaguaaugacugucaugaaagcagcauugaaauaauuuguuuaaagggggcacucuuuuaaacgggaagaaaauuuccgcuuccuggucuuaucauggacaauuugggcuagaggcaggaaggaagugggaugaccucaggaggucaccuuuucuugauuccagaaacauaugggcugauaaacccggggugaccucaugaaaugaguugcagcagaaguuuauuuuuuucagaacaagugauguuugauggaccucugaaucucuuuagggagacacagauggcugggaucccuccccuguacccuucucacugccaggagaacuacgugugaagguauucaaggcagggaguauacauugcuguuuccuguugggcaaugcuccuugaccacauuuugggaagaguggauguuaucauugagaaaacaaugugucuggaauuaaugggguucuuauaaagaagguucccagaaaagaauguucauccagccuccucagaaacagaacauucaagaaaaggacaaucaggaugucaucagggaaaugaaaauaaaaaccacaaugagauaucaccuuauaccagguagaauggcuacuauaaaaaaaugaagugucaucaaggauauagagaaauuggaacccuucuucacugcuggagggaauggaaaaugguguagccguuaugaaaaacaguacggagguuucucaaaaauuaaaaauagaacugcuauaugauccagcaaucucacuucuguauauauacccaaaauaauugaaaucagaauuucaagaaaauauuuacacucccauguucauuguggcacucuucacaaucacuguuuccaaaguuauggaaacaacccaaauuuccauugaaaaauaaauggacaaagaaaaugugcauauacguacaaugggauauuauucagccuaaaaaaagggggaauccuguuauuuaugacaacaugaauaaacccggaggccauuaugcuauguaaaaugagcaaguaacagaaagacaaauacugccugauuucauuuauaugagguucuaaaauagucaaacucauagaagcagagaauagaacagugguuccuagggaaaaggaggaagggagaaaugaggaaauagggaguugucuaauugguauaaaauuauaguaugcaagaugaauuagcucuaaagaucagcuguauagcagaguucguauaaugaacaauacuguauuaugcacuuaacauuuuguuaagaggguaccucucauguuaaguguucuuaccauauacauauacacaaggaagcuuuuggaggugauggauauauuuauuaccuugauuguggugaugguuugacagguaugugacuaugucuaaacucaucaaauuguauacauuaaauauaugcaguuuuauaauaucaauuaugucugaaugaagcuauaaaaaagaaaagacaacaaaauucaguugucaaaacuggaaauaugaccacagucagaaguguuuguuacugaguguuucagaguguguuugguuugagcaggucuagggugauugaacaucccuggguguguuuccaugucucauguacuagugaaaguagaugugugcauuugugcacauaucccuauguaucccuaucagggcuguguguauuugaaaguguguguguccgcaugaucauaucuguauagaagagagugugauuauauuucuugaagaauacauccauuugaaauggaugucuauggcuguuugagaugaguucucuacucuugugcuuguacaguagucuccccuuaucccuuaugcuugguggauacguucuuagaccccaaguggaucucugagaccgcagaugguaccaaaccucauauaugcaauauuuuuuccuauacauaaauaccuaagauaaaguucaucuucugaauuaggcacaguaagagauuaacaauaacuaacaauaaaauugaauaguuauaauaauauauuguaauaaaaguuaugugaaugugaucucuuucuuucucucucucaaaaaaaaaaaaaaaaaa

SEQ ID NO: 5 - RNA, 19 nt, artificial
  Chemically synthesized
gcugcauauuccaagguuu

SEQ ID NO: 6 - RNA, 19 nt, artificial
  Chemically synthesized
ggaagauaaugaacaccaa

SEQ ID NO: 7 - RNA, 19 nt, artificial
  Chemically synthesized
cccucucuacaaacuuuaa

SEQ ID NO: 8 - RNA, 19 nt, artificial
  Chemically synthesized
ggagcccauugagaaaaaa

SEQ ID NO: 9 - RNA, 19 nt, artificial
  Chemically synthesized
cggaguucucccaguguuu

SEQ ID NO: 10 - RNA, 19 nt, artificial
  Chemically synthesized
cccuuaauggaguugguaa

SEQ ID NO: 11 - RNA, 19 nt, artificial
  Chemically synthesized
gagauaaccaugaucauaa

SEQ ID NO: 12 - RNA, 19 nt, artificial
  Chemically synthesized
gggacuucauuccuggcaa

SEQ ID NO: 13 - RNA, 19 nt, artificial
  Chemically synthesized
gucuauuacugauaucuga

SEQ ID NO: 14 - RNA, 19 nt, artificial
  Chemically synthesized
ccaaaaaguuugaagucaa

SEQ ID NO: 15 - RNA, 19 nt, artificial
  Chemically synthesized
ggagcaacuugacucauuu

SEQ ID NO: 16 - RNA, 19 nt, artificial
  Chemically synthesized
ggccugugguauaugaaaa

SEQ ID NO: 17 - RNA, 19 nt, artificial
  Chemically synthesized
ggcucagcgggaaggauuu

SEQ ID NO: 18 - RNA, 19 nt, artificial
  Chemically synthesized
ggagauuuuuguagauguu

SEQ ID NO: 19 - RNA, 19 nt, artificial
  Chemically synthesized
gguuccuuguuuacuuuca

SEQ ID NO: 20 - RNA, 19 nt, artificial
  Chemically synthesized
gcaacaaggcaaaguauuu

SEQ ID NO: 21 - RNA, 19 nt, artificial
  Chemically synthesized
cuuucuuccugcuaagaga

SEQ ID NO: 22 - RNA, 19 nt, artificial
  Chemically synthesized
gaccagucuuugucuaguu

SEQ ID NO: 23 - RNA, 19 nt, artificial
  Chemically synthesized
ggcuuaguucauuaggaaa

SEQ ID NO: 24 - RNA, 19 nt, artificial
  Chemically synthesized
gcccucucuacaaacuuua

SEQ ID NO: 25 - RNA, 19 nt, artificial
  Chemically synthesized
ccaugaucauaagucuauu

SEQ ID NO: 26 - RNA, 19 nt, artificial
  Chemically synthesized
cuuguuuacuuucacaaca

SEQ ID NO: 27 - RNA, 19 nt, artificial
  Chemically synthesized
ggguugaagcacuggacaa

SEQ ID NO: 28 - RNA, 19 nt, artificial
  Chemically synthesized
gucuaguugggaucuuuau

SEQ ID NO: 29 - RNA, 19 nt, artificial
  Chemically synthesized
ggaucuuuaugucacuagu

SEQ ID NO: 30 - RNA, 19 nt, artificial
  Chemically synthesized
ggaaaaaaccggagagacu

SEQ ID NO: 31 - RNA, 19 nt, artificial
  Chemically synthesized
gcuguguauuuccuauuaa

SEQ ID NO: 32 - RNA, 19 nt, artificial
  Chemically synthesized
ggaucucagugaaaauuug

SEQ ID NO: 33 - RNA, 19 nt, artificial
  Chemically synthesized
cauucuuucuuccugcuaa

SEQ ID NO: 34 - RNA, 19 nt, artificial
  Chemically synthesized
ggauccaaaggagaccuau

SEQ ID NO: 35 - RNA, 19 nt, artificial
  Chemically synthesized
cugggaaauccuuacaaaa

SEQ ID NO: 36 - RNA, 19 nt, artificial
  Chemically synthesized
gucuuuuugaugagaacaa

SEQ ID NO: 37 - RNA, 19 nt, artificial
  Chemically synthesized
ggugaaacaaauucauuga

SEQ ID NO: 38 - RNA, 19 nt, artificial
  Chemically synthesized
cugucuuugugcuuucuga

SEQ ID NO: 39 - RNA, 19 nt, artificial
  Chemically synthesized
agaacuauccacuggugaa

SEQ ID NO: 40 - RNA, 19 nt, artificial
  Chemically synthesized
guuugaagucaauucagaa

SEQ ID NO: 41 - RNA, 19 nt, artificial
  Chemically synthesized
uggagcccauugagaaaaa

SEQ ID NO: 42 - RNA, 19 nt, artificial
  Chemically synthesized
cccaaaacuuguugcuauu

SEQ ID NO: 43 - RNA, 19 nt, artificial
  Chemically synthesized
ugucuaguugggaucuuua

SEQ ID NO: 44 - RNA, 19 nt, artificial
  Chemically synthesized
ggugcaaguaugaacugga

SEQ ID NO: 45 - RNA, 19 nt, artificial
  Chemically synthesized
guugcuauuccuagaaaaa

SEQ ID NO: 46 - RNA, 19 nt, artificial
  Chemically synthesized
cgggaaggauuuuggguaa

SEQ ID NO: 47 - RNA, 19 nt, artificial
  Chemically synthesized
ggcugcauauuccaagguu

SEQ ID NO: 48 - RNA, 19 nt, artificial
  Chemically synthesized
cucugaaaaacuugacuaa

SEQ ID NO: 49 - RNA, 19 nt, artificial
  Chemically synthesized
gagacuuugcucacucuga

SEQ ID NO: 50 - RNA, 19 nt, artificial
  Chemically synthesized
cucuuagugaccaagugaa

SEQ ID NO: 51 - RNA, 19 nt, artificial
  Chemically synthesized
uggagaaccuuauggucca

SEQ ID NO: 52 - RNA, 19 nt, artificial
  Chemically synthesized
ggaucauugacaauaucau

SEQ ID NO: 53 - RNA, 19 nt, artificial
  Chemically synthesized
ggaucaccuacauuagcaa

SEQ ID NO: 54 - RNA, 19 nt, artificial
  Chemically synthesized
ggagcuggagaacuucaau

SEQ ID NO: 55 - RNA, 19 nt, artificial
  Chemically synthesized
ggcucacagaagcuguaaa

SEQ ID NO: 56 - RNA, 19 nt, artificial
  Chemically synthesized
aguggaucauugacaauau

SEQ ID NO: 57 - RNA, 19 nt, artificial
  Chemically synthesized
gccaaagucuugauugauu

SEQ ID NO: 58 - RNA, 19 nt, artificial
  Chemically synthesized
gaacaaugaugcugccauu

SEQ ID NO: 59 - RNA, 19 nt, artificial
  Chemically synthesized
agacuuugcucacucugaa

SEQ ID NO: 60 - RNA, 19 nt, artificial
  Chemically synthesized
gucuuugucuaguugggau

SEQ ID NO: 61 - RNA, 19 nt, artificial
  Chemically synthesized
cuggauuguuagaauuaga

SEQ ID NO: 62 - RNA, 19 nt, artificial
  Chemically synthesized
gacuaacauugauaucagu

SEQ ID NO: 63 - RNA, 19 nt, artificial
  Chemically synthesized
guugcaagcaggauccaaa

SEQ ID NO: 64 - RNA, 19 nt, artificial
  Chemically synthesized
ggguggagaaccuuauggu

SEQ ID NO: 65 - RNA, 19 nt, artificial
  Chemically synthesized
guugaugacucuaccagau

SEQ ID NO: 66 - RNA, 19 nt, artificial
  Chemically synthesized
cacaguugguugacuucau

SEQ ID NO: 67 - RNA, 19 nt, artificial
  Chemically synthesized
cucuggugcugacauccaa

SEQ ID NO: 68 - RNA, 19 nt, artificial
  Chemically synthesized
cgcaacucaaagaacuuua

SEQ ID NO: 69 - RNA, 19 nt, artificial
  Chemically synthesized
ggacuugcuuacuaaaacu

SEQ ID NO: 70 - RNA, 19 nt, artificial
  Chemically synthesized
gaugcagaacccauggaua

SEQ ID NO: 71 - RNA, 19 nt, artificial
  Chemically synthesized
cuuggaucucagugaaaau

SEQ ID NO: 72 - RNA, 19 nt, artificial
  Chemically synthesized
uguugcuauuccuagaaaa

SEQ ID NO: 73 - RNA, 19 nt, artificial
  Chemically synthesized
ggacaaugccacauacuuu

SEQ ID NO: 74 - RNA, 19 nt, artificial
  Chemically synthesized
ggaacugcgagauacugau

SEQ ID NO: 75 - RNA, 19 nt, artificial
  Chemically synthesized
cccaguguuugguguugca

SEQ ID NO: 76 - RNA, 19 nt, artificial
  Chemically synthesized
caacuggcuuaguucauua

SEQ ID NO: 77 - RNA, 19 nt, artificial
  Chemically synthesized
guccuagguucccauauuu

SEQ ID NO: 78 - RNA, 19 nt, artificial
  Chemically synthesized
gaguuauagauccagguaa

SEQ ID NO: 79 - RNA, 19 nt, artificial
  Chemically synthesized
gccgcaacucaaagaacuu

SEQ ID NO: 80 - RNA, 19 nt, artificial
  Chemically synthesized
aguugaugacucuaccaga

SEQ ID NO: 81 - RNA, 19 nt, artificial
  Chemically synthesized
ugggcagucuugaacauuu

SEQ ID NO: 82 - RNA, 19 nt, artificial
  Chemically synthesized
acacgaauacacaguguaa

SEQ ID NO: 83 - RNA, 19 nt, artificial
  Chemically synthesized
ugugcuuucugaaaacuuu

SEQ ID NO: 84 - RNA, 19 nt, artificial
  Chemically synthesized
agagcaacaaggcaaagua

SEQ ID NO: 85 - RNA, 19 nt, artificial
  Chemically synthesized
ccuacauuagcaacaguga

SEQ ID NO: 86 - RNA, 19 nt, artificial
  Chemically synthesized
agaaaaaagugcuguguau

SEQ ID NO: 87 - RNA, 19 nt, artificial
  Chemically synthesized
gucggaaugucacaggaca

SEQ ID NO: 88 - RNA, 19 nt, artificial
  Chemically synthesized
ccaauggaauuaacacaau

SEQ ID NO: 89 - RNA, 19 nt, artificial
  Chemically synthesized
cacacugaagacuuuggaa

SEQ ID NO: 90 - RNA, 19 nt, artificial
  Chemically synthesized
cuucauaugaagcagcaua

SEQ ID NO: 91 - RNA, 19 nt, artificial
  Chemically synthesized
ggugacugcucggaguucu

SEQ ID NO: 92 - RNA, 19 nt, artificial
  Chemically synthesized
cacaguagaaaacaguaaa

SEQ ID NO: 93 - RNA, 19 nt, artificial
  Chemically synthesized
cugguuccuuguuuacuuu

SEQ ID NO: 94 - RNA, 19 nt, artificial
  Chemically synthesized
cuggagcccauugagaaaa

SEQ ID NO: 95 - RNA, 19 nt, artificial
  Chemically synthesized
ccuucaaguugugucuuca

SEQ ID NO: 96 - RNA, 19 nt, artificial
  Chemically synthesized
gcuaugagccaaaaaguuu

SEQ ID NO: 97 - RNA, 19 nt, artificial
  Chemically synthesized
caaugacugugucauucuu

SEQ ID NO: 98 - RNA, 19 nt, artificial
  Chemically synthesized
cauugagaaaaaagccauu

SEQ ID NO: 99 - RNA, 19 nt, artificial
  Chemically synthesized
caguguaacaggcugcauu

SEQ ID NO: 100 - RNA, 19 nt, artificial
  Chemically synthesized
gucuuugugcuuucugaaa

SEQ ID NO: 101 - RNA, 19 nt, artificial
  Chemically synthesized
gcaacucaaagaacuuuau

SEQ ID NO: 102 - RNA, 19 nt, artificial
  Chemically synthesized
cauauuuaagaccagucuu

SEQ ID NO: 103 - RNA, 19 nt, artificial
  Chemically synthesized
ggaacuugagauugaugcu

SEQ ID NO: 104 - RNA, 19 nt, artificial
  Chemically synthesized
cugaaaaacuugacuaaca

SEQ ID NO: 105 - RNA, 19 nt, artificial
  Chemically synthesized
gguugaagcacuggacaau

SEQ ID NO: 106 - RNA, 19 nt, artificial
  Chemically synthesized
cccuuucuucuuuaacauu

SEQ ID NO: 107 - RNA, 19 nt, artificial
  Chemically synthesized
cccuugguauccaagggaa

SEQ ID NO: 108 - RNA, 19 nt, artificial
  Chemically synthesized
acuugagauugaugcuuca

SEQ ID NO: 109 - RNA, 19 nt, artificial
  Chemically synthesized
cauugaaaagagccacaaa

SEQ ID NO: 110 - RNA, 19 nt, artificial
  Chemically synthesized
acuuggaucucagugaaaa

SEQ ID NO: 111 - RNA, 19 nt, artificial
  Chemically synthesized
aucugauccuucauaugaa

SEQ ID NO: 112 - RNA, 19 nt, artificial
  Chemically synthesized
gagcaacaaggcaaaguau

SEQ ID NO: 113 - RNA, 19 nt, artificial
  Chemically synthesized
gguggcaauaacuucauuu

SEQ ID NO: 114 - RNA, 19 nt, artificial
  Chemically synthesized
cuugcuuacuaaaacuaca

SEQ ID NO: 115 - RNA, 19 nt, artificial
  Chemically synthesized
aguccuagguucccauauu

SEQ ID NO: 116 - RNA, 19 nt, artificial
  Chemically synthesized
ggacuucauuccuggcaag

SEQ ID NO: 117 - RNA, 19 nt, artificial
  Chemically synthesized
gggccaacuguaaucugua

SEQ ID NO: 118 - RNA, 19 nt, artificial
  Chemically synthesized
gccagaaaagaugaaauau

SEQ ID NO: 119 - RNA, 19 nt, artificial
  Chemically synthesized
gagagacuuugcucacucu

SEQ ID NO: 120 - RNA, 19 nt, artificial
  Chemically synthesized
ugcuguguauuuccuauua

SEQ ID NO: 121 - RNA, 19 nt, artificial
  Chemically synthesized
gccaaaaaguuugaaguca

SEQ ID NO: 122 - RNA, 19 nt, artificial
  Chemically synthesized
gugaguggugcaaguauga

SEQ ID NO: 123 - RNA, 19 nt, artificial
  Chemically synthesized
gacucauuucacacacuga

SEQ ID NO: 124 - RNA, 19 nt, artificial
  Chemically synthesized
agagcaucugauaaugaca

SEQ ID NO: 125 - RNA, 19 nt, artificial
  Chemically synthesized
cugcuaugaugcauuuguu

SEQ ID NO: 126 - RNA, 19 nt, artificial
  Chemically synthesized
ggguccugugccaccguuu

SEQ ID NO: 127 - RNA, 19 nt, artificial
  Chemically synthesized
gcaaguaugaacuggacuu

SEQ ID NO: 128 - RNA, 19 nt, artificial
  Chemically synthesized
agcugcggaagauaaugaa

SEQ ID NO: 129 - RNA, 19 nt, artificial
  Chemically synthesized
cacuuacagaaagaguuaa

SEQ ID NO: 130 - RNA, 19 nt, artificial
  Chemically synthesized
gucuugaacauuuagacuu

SEQ ID NO: 131 - RNA, 19 nt, artificial
  Chemically synthesized
ccauugagaaaaaagccau

SEQ ID NO: 132 - RNA, 19 nt, artificial
  Chemically synthesized
aucugauaaugacagaguu

SEQ ID NO: 133 - RNA, 19 nt, artificial
  Chemically synthesized
agaccagucuuugucuagu

SEQ ID NO: 134 - RNA, 19 nt, artificial
  Chemically synthesized
gugugaaccuccaggcucu

SEQ ID NO: 135 - RNA, 19 nt, artificial
  Chemically synthesized
ggcuccaggccaaaaggaa

SEQ ID NO: 136 - RNA, 19 nt, artificial
  Chemically synthesized
gcugcauucccaagacacu

SEQ ID NO: 137 - RNA, 19 nt, artificial
  Chemically synthesized
ccugugaauuccucuccuu

SEQ ID NO: 138 - RNA, 19 nt, artificial
  Chemically synthesized
gagccacaaaacugucuuu

SEQ ID NO: 139 - RNA, 19 nt, artificial
  Chemically synthesized
ccuugaggaacuugagauu

SEQ ID NO: 140 - RNA, 19 nt, artificial
  Chemically synthesized
cacuuuccauuuuucagaa

SEQ ID NO: 141 - RNA, 19 nt, artificial
  Chemically synthesized
gggccuggcuccaggccaa

SEQ ID NO: 142 - RNA, 19 nt, artificial
  Chemically synthesized
gacuuugcucacucugaaa

SEQ ID NO: 143 - RNA, 19 nt, artificial
  Chemically synthesized
ggauuguuagaauuagagu

SEQ ID NO: 144 - RNA, 19 nt, artificial
  Chemically synthesized
aguuguggguugaagcacu

SEQ ID NO: 145 - RNA, 19 nt, artificial
  Chemically synthesized
cugacauccaauggaauua

SEQ ID NO: 146 - RNA, 19 nt, artificial
  Chemically synthesized
ggcaauaacuucauuugcu

SEQ ID NO: 147 - RNA, 19 nt, artificial
  Chemically synthesized
guuugaugacuguacccuu

SEQ ID NO: 148 - RNA, 19 nt, artificial
  Chemically synthesized
gcucacagaagcuguaaaa

SEQ ID NO: 149 - RNA, 19 nt, artificial
  Chemically synthesized
gaaaaaaccggagagacuu

SEQ ID NO: 150 - RNA, 19 nt, artificial
  Chemically synthesized
gaucuuuaugucacuaguu

SEQ ID NO: 151 - RNA, 19 nt, artificial
  Chemically synthesized
gccugugguauaugaaaau

SEQ ID NO: 152 - RNA, 19 nt, artificial
  Chemically synthesized
ggcaaguggaucauugaca

SEQ ID NO: 153 - RNA, 19 nt, artificial
  Chemically synthesized
gaugcauuuguuucuuaca

SEQ ID NO: 154 - RNA, 19 nt, artificial
  Chemically synthesized
agcaacaaggcaaaguauu

SEQ ID NO: 155 - RNA, 19 nt, artificial
  Chemically synthesized
cugcauauuccaagguuuu

SEQ ID NO: 156 - RNA, 19 nt, artificial
  Chemically synthesized
cgagauacugauuuggaca

SEQ ID NO: 157 - RNA, 19 nt, artificial
  Chemically synthesized
ugcagaacccauggauaua

SEQ ID NO: 158 - RNA, 19 nt, artificial
  Chemically synthesized
gaucugagcacuuuauauu

SEQ ID NO: 159 - RNA, 19 nt, artificial
  Chemically synthesized
gaucauaagucuauuacug

SEQ ID NO: 160 - RNA, 19 nt, artificial
  Chemically synthesized
ggauccucguggauaucaa

SEQ ID NO: 161 - RNA, 19 nt, artificial
  Chemically synthesized
ucuggagcccauugagaaa

SEQ ID NO: 162 - RNA, 19 nt, artificial
  Chemically synthesized
gaauauagucccuugguau

SEQ ID NO: 163 - RNA, 19 nt, artificial
  Chemically synthesized
cucaagagcaacaaggcaa

SEQ ID NO: 164 - RNA, 19 nt, artificial
  Chemically synthesized
gcuucugcaagcugcggaa

SEQ ID NO: 165 - RNA, 19 nt, artificial
  Chemically synthesized
cagugaaaauuugaugguu

SEQ ID NO: 166 - RNA, 19 nt, artificial
  Chemically synthesized
gaaaguuuguuucagguua

SEQ ID NO: 167 - RNA, 19 nt, artificial
  Chemically synthesized
ccucucuacaaacuuuaau

SEQ ID NO: 168 - RNA, 19 nt, artificial
  Chemically synthesized
ugagauaaccaugaucaua

SEQ ID NO: 169 - RNA, 19 nt, artificial
  Chemically synthesized
caaggaagaauccuccaau

SEQ ID NO: 170 - RNA, 19 nt, artificial
  Chemically synthesized
gcucuuucacugcuuucaa

SEQ ID NO: 171 - RNA, 19 nt, artificial
  Chemically synthesized
cuggcuuaguucauuagga

SEQ ID NO: 172 - RNA, 19 nt, artificial
  Chemically synthesized
gcaacuggcuuaguucauu

SEQ ID NO: 173 - RNA, 19 nt, artificial
  Chemically synthesized
ucggaguucucccaguguu

SEQ ID NO: 174 - RNA, 19 nt, artificial
  Chemically synthesized
ccaaaaggaagcccaggaa

SEQ ID NO: 175 - RNA, 19 nt, artificial
  Chemically synthesized
ugcucggaguucucccagu

SEQ ID NO: 176 - RNA, 19 nt, artificial
  Chemically synthesized
gccacaaaaggcauucucu

SEQ ID NO: 177 - RNA, 19 nt, artificial
  Chemically synthesized
uggaguugguaauuuuaga

SEQ ID NO: 178 - RNA, 19 nt, artificial
  Chemically synthesized
acaccuucacuaagauuca

SEQ ID NO: 179 - RNA, 19 nt, artificial
  Chemically synthesized
cggagagacuuugcucacu

SEQ ID NO: 180 - RNA, 19 nt, artificial
  Chemically synthesized
cguggauaucaaaauucau

SEQ ID NO: 181 - RNA, 19 nt, artificial
  Chemically synthesized
acgaauacacaguguaaca

SEQ ID NO: 182 - RNA, 19 nt, artificial
  Chemically synthesized
acuuguugcuauuccuaga

SEQ ID NO: 183 - RNA, 19 nt, artificial
  Chemically synthesized
agcuaugagccaaaaaguu

SEQ ID NO: 184 - RNA, 19 nt, artificial
  Chemically synthesized
gagugaguggugcaaguau

SEQ ID NO: 185 - RNA, 19 nt, artificial
  Chemically synthesized
guuuguuucagguuaugaa

SEQ ID NO: 186 - RNA, 19 nt, artificial
  Chemically synthesized
gggcucacagaagcuguaa

SEQ ID NO: 187 - RNA, 19 nt, artificial
  Chemically synthesized
caguaggaaugcaauaacu

SEQ ID NO: 188 - RNA, 19 nt, artificial
  Chemically synthesized
ugcauuuguuucuuacagu

SEQ ID NO: 189 - RNA, 19 nt, artificial
  Chemically synthesized
accuucacuaagauucaaa

SEQ ID NO: 190 - RNA, 19 nt, artificial
  Chemically synthesized
ccuacuggguggagaaccu

SEQ ID NO: 191 - RNA, 19 nt, artificial
  Chemically synthesized
gcaagcugcggaagauaau

SEQ ID NO: 192 - RNA, 19 nt, artificial
  Chemically synthesized
gcaaaaucauuuggcauca

SEQ ID NO: 193 - RNA, 19 nt, artificial
  Chemically synthesized
caaaaggaagcccaggaaa

SEQ ID NO: 194 - RNA, 19 nt, artificial
  Chemically synthesized
ccaaggaagaauccuccaa

SEQ ID NO: 195 - RNA, 19 nt, artificial
  Chemically synthesized
gugaaaaucaccgaugaaa

SEQ ID NO: 196 - RNA, 19 nt, artificial
  Chemically synthesized
gcugacauccaauggaauu

SEQ ID NO: 197 - RNA, 19 nt, artificial
  Chemically synthesized
ggacgaggcucagcgggaa

SEQ ID NO: 198 - RNA, 19 nt, artificial
  Chemically synthesized
cgucuuuuugaugagaaca

SEQ ID NO: 199 - RNA, 19 nt, artificial
  Chemically synthesized
ugcaagcugcggaagauaa

SEQ ID NO: 200 - RNA, 19 nt, artificial
  Chemically synthesized
cuggcaaguggaucauuga

SEQ ID NO: 201 - RNA, 19 nt, artificial
  Chemically synthesized
gcaggaacaucugcuauga

SEQ ID NO: 202 - RNA, 19 nt, artificial
  Chemically synthesized
ugguugaagaauacuugaa

SEQ ID NO: 203 - RNA, 19 nt, artificial
  Chemically synthesized
caucucacaaaauugcaaa

SEQ ID NO: 204 - RNA, 19 nt, artificial
  Chemically synthesized
aguuugaagucaauucaga

SEQ ID NO: 205 - RNA, 19 nt, artificial
  Chemically synthesized
caucugcuaugaugcauuu

SEQ ID NO: 206 - RNA, 19 nt, artificial
  Chemically synthesized
cagccucuccaaggaagaa

SEQ ID NO: 207 - RNA, 19 nt, artificial
  Chemically synthesized
auauggacaccuucacuaa

SEQ ID NO: 208 - RNA, 19 nt, artificial
  Chemically synthesized
gggaaggauuuuggguaaa

SEQ ID NO: 209 - RNA, 19 nt, artificial
  Chemically synthesized
acuugucaguggccagaaa

SEQ ID NO: 210 - RNA, 19 nt, artificial
  Chemically synthesized
aggcugcauucccaagaca

SEQ ID NO: 211 - RNA, 19 nt, artificial
  Chemically synthesized
ccgucuuuuugaugagaac

SEQ ID NO: 212 - RNA, 19 nt, artificial
  Chemically synthesized
cagagcuaugagccaaaaa

SEQ ID NO: 213 - RNA, 19 nt, artificial
  Chemically synthesized
guucccauauuuaagacca

SEQ ID NO: 214 - RNA, 19 nt, artificial
  Chemically synthesized
gcugguggcaauaacuuca

SEQ ID NO: 215 - RNA, 19 nt, artificial
  Chemically synthesized
ugucuuugugcuuucugaa

SEQ ID NO: 216 - RNA, 19 nt, artificial
  Chemically synthesized
gcuuucaacugguaguugu

SEQ ID NO: 217 - RNA, 19 nt, artificial
  Chemically synthesized
gcgggaaggauuuugggua

SEQ ID NO: 218 - RNA, 19 nt, artificial
  Chemically synthesized
aucuguagcaacuggcuua

SEQ ID NO: 219 - RNA, 19 nt, artificial
  Chemically synthesized
cauaugaagcagcauauuu

SEQ ID NO: 220 - RNA, 19 nt, artificial
  Chemically synthesized
gagccaaaaaguuugaagu

SEQ ID NO: 221 - RNA, 19 nt, artificial
  Chemically synthesized
cugcggaagauaaugaaca

SEQ ID NO: 222 - RNA, 19 nt, artificial
  Chemically synthesized
ccauauuuaagaccagucu

SEQ ID NO: 223 - RNA, 19 nt, artificial
  Chemically synthesized
gaucucagugaaaauuuga

SEQ ID NO: 224 - RNA, 19 nt, artificial
  Chemically synthesized
cuugaaaaauucagccugu

SEQ ID NO: 225 - RNA, 19 nt, artificial
  Chemically synthesized
caagacacuggaaauuuua

SEQ ID NO: 226 - RNA, 19 nt, artificial
  Chemically synthesized
gccucuccaaggaagaauc

SEQ ID NO: 227 - RNA, 19 nt, artificial
  Chemically synthesized
gggugcuguuuuauaaaca

SEQ ID NO: 228 - RNA, 19 nt, artificial
  Chemically synthesized
uaagaccagucuuugucua

SEQ ID NO: 229 - RNA, 19 nt, artificial
  Chemically synthesized
ggcccauggacgaggcuca

SEQ ID NO: 230 - RNA, 19 nt, artificial
  Chemically synthesized
gcuggagauuuuuguagau

SEQ ID NO: 231 - RNA, 19 nt, artificial
  Chemically synthesized
agugcuguguauuuccuau

SEQ ID NO: 232 - RNA, 19 nt, artificial
  Chemically synthesized
gggucaucaucagccucuc

SEQ ID NO: 233 - RNA, 19 nt, artificial
  Chemically synthesized
uggcuuaguucauuaggaa

SEQ ID NO: 234 - RNA, 19 nt, artificial
  Chemically synthesized
ugaugacuguacccuuaau

SEQ ID NO: 235 - RNA, 19 nt, artificial
  Chemically synthesized
gauugauuggccagcaaau

SEQ ID NO: 236 - RNA, 19 nt, artificial
  Chemically synthesized
ccuugguauccaagggaau

SEQ ID NO: 237 - RNA, 19 nt, artificial
  Chemically synthesized
gaaucacaguagaaaacag

SEQ ID NO: 238 - RNA, 19 nt, artificial
  Chemically synthesized
ccuuguuuacuuucacaac

SEQ ID NO: 239 - RNA, 19 nt, artificial
  Chemically synthesized
gcauuuguuucuuacagug

SEQ ID NO: 240 - RNA, 19 nt, artificial
  Chemically synthesized
cauuuguuucuuacaguga

SEQ ID NO: 241 - RNA, 19 nt, artificial
  Chemically synthesized
uugucuaguugggaucuuu

SEQ ID NO: 242 - RNA, 19 nt, artificial
  Chemically synthesized
aggauccaaaggagaccua

SEQ ID NO: 243 - RNA, 19 nt, artificial
  Chemically synthesized
cuacguggauguaccguca

SEQ ID NO: 244 - RNA, 19 nt, artificial
  Chemically synthesized
cuuugcucacucugaaaaa

SEQ ID NO: 245 - RNA, 19 nt, artificial
  Chemically synthesized
gaaugcaauaacuacguuu

SEQ ID NO: 246 - RNA, 19 nt, artificial
  Chemically synthesized
cccauugagaaaaaagcca

SEQ ID NO: 247 - RNA, 19 nt, artificial
  Chemically synthesized
caauucagaauguaaguca

SEQ ID NO: 248 - RNA, 19 nt, artificial
  Chemically synthesized
ucuuugugcuuucugaaaa

SEQ ID NO: 249 - RNA, 19 nt, artificial
  Chemically synthesized
caaucaggcuucucugucu

SEQ ID NO: 250 - RNA, 19 nt, artificial
  Chemically synthesized
gaguuaaaagaaucacagu

SEQ ID NO: 251 - RNA, 19 nt, artificial
  Chemically synthesized
gccacaaaacugucuuugu

SEQ ID NO: 252 - RNA, 19 nt, artificial
  Chemically synthesized
gaauuaacacaauagagga

SEQ ID NO: 253 - RNA, 19 nt, artificial
  Chemically synthesized
ugguccaggagcuggagaa

SEQ ID NO: 254 - RNA, 19 nt, artificial
  Chemically synthesized
ugugaauuccucuccuuca

SEQ ID NO: 255 - RNA, 19 nt, artificial
  Chemically synthesized
ggugcugacauccaaugga

SEQ ID NO: 256 - RNA, 19 nt, artificial
  Chemically synthesized
cuguacccuuaauggaguu

SEQ ID NO: 257 - RNA, 19 nt, artificial
  Chemically synthesized
gaugcuucagaucuacaga

SEQ ID NO: 258 - RNA, 19 nt, artificial
  Chemically synthesized
acucauuucacacacugaa

SEQ ID NO: 259 - RNA, 19 nt, artificial
  Chemically synthesized
cuacagagcuaugagccaa

SEQ ID NO: 260 - RNA, 19 nt, artificial
  Chemically synthesized
cacacgaauacacagugua

SEQ ID NO: 261 - RNA, 19 nt, artificial
  Chemically synthesized
ugacuucauggaugcagaa

SEQ ID NO: 262 - RNA, 19 nt, artificial
  Chemically synthesized
ucuuaaacuuacugggaaa

SEQ ID NO: 263 - RNA, 19 nt, artificial
  Chemically synthesized
uacuggguggagaaccuua

SEQ ID NO: 264 - RNA, 19 nt, artificial
  Chemically synthesized
ugacauccaauggaauuaa

SEQ ID NO: 265 - RNA, 19 nt, artificial
  Chemically synthesized
ggaguucucccaguguuug

SEQ ID NO: 266 - RNA, 19 nt, artificial
  Chemically synthesized
gcaggauccucguggauau

SEQ ID NO: 267 - RNA, 19 nt, artificial
  Chemically synthesized
auugaaaagagccacaaaa

SEQ ID NO: 268 - RNA, 19 nt, artificial
  Chemically synthesized
uacccauguuacuaguauu

SEQ ID NO: 269 - RNA, 19 nt, artificial
  Chemically synthesized
ugcuauuccuagaaaaaag

SEQ ID NO: 270 - RNA, 19 nt, artificial
  Chemically synthesized
ggaugcagaacccauggau

SEQ ID NO: 271 - RNA, 19 nt, artificial
  Chemically synthesized
gcacaaaugaacuuaagau

SEQ ID NO: 272 - RNA, 19 nt, artificial
  Chemically synthesized
gccaaaaggaagcccagga

SEQ ID NO: 273 - RNA, 19 nt, artificial
  Chemically synthesized
cuucauuugcuccugugaa

SEQ ID NO: 274 - RNA, 19 nt, artificial
  Chemically synthesized
ggaaggauuuuggguaaau

SEQ ID NO: 275 - RNA, 19 nt, artificial
  Chemically synthesized
caccgaugaaaguuuguuu

SEQ ID NO: 276 - RNA, 19 nt, artificial
  Chemically synthesized
uucuggagcccauugagaa

SEQ ID NO: 277 - RNA, 19 nt, artificial
  Chemically synthesized
gcaaauccugagaguggga

SEQ ID NO: 278 - RNA, 19 nt, artificial
  Chemically synthesized
aaccaugaucauaagucua

SEQ ID NO: 279 - RNA, 19 nt, artificial
  Chemically synthesized
ccugggcagucuugaacau

SEQ ID NO: 280 - RNA, 19 nt, artificial
  Chemically synthesized
cugugguauaugaaaauga

SEQ ID NO: 281 - RNA, 19 nt, artificial
  Chemically synthesized
accggagagacuuugcuca

SEQ ID NO: 282 - RNA, 19 nt, artificial
  Chemically synthesized
aaugguaucugcaagggca

SEQ ID NO: 283 - RNA, 19 nt, artificial
  Chemically synthesized
ccgcaacucaaagaacuuu

SEQ ID NO: 284 - RNA, 19 nt, artificial
  Chemically synthesized
ugaauuugccgcaacucaa

SEQ ID NO: 285 - RNA, 19 nt, artificial
  Chemically synthesized
aggagcuggagaacuucaa

SEQ ID NO: 286 - RNA, 19 nt, artificial
  Chemically synthesized
cucacagaagcuguaaaaa

SEQ ID NO: 287 - RNA, 19 nt, artificial
  Chemically synthesized
acuggguggagaaccuuau

SEQ ID NO: 288 - RNA, 19 nt, artificial
  Chemically synthesized
cacaaaaggcauucucugu

SEQ ID NO: 289 - RNA, 19 nt, artificial
  Chemically synthesized
ucaucaucagccucuccaa

SEQ ID NO: 290 - RNA, 19 nt, artificial
  Chemically synthesized
cuacguuuucuaaggagca

SEQ ID NO: 291 - RNA, 19 nt, artificial
  Chemically synthesized
cagaacccauggauauaga

SEQ ID NO: 292 - RNA, 19 nt, artificial
  Chemically synthesized
aguugguaauuuuagagca

SEQ ID NO: 293 - RNA, 19 nt, artificial
  Chemically synthesized
ugaugguugaagaauacuu

SEQ ID NO: 294 - RNA, 19 nt, artificial
  Chemically synthesized
ccucguggauaucaaaauu

SEQ ID NO: 295 - RNA, 19 nt, artificial
  Chemically synthesized
agugaguggugcaaguaug

SEQ ID NO: 296 - RNA, 19 nt, artificial
  Chemically synthesized
cacuggugaaacaaauuca

SEQ ID NO: 297 - RNA, 19 nt, artificial
  Chemically synthesized
ucugguuccuuguuuacuu

SEQ ID NO: 298 - RNA, 19 nt, artificial
  Chemically synthesized
augccuacuggguggagaa

SEQ ID NO: 299 - RNA, 19 nt, artificial
  Chemically synthesized
cagucuuugucuaguuggg

SEQ ID NO: 300 - RNA, 19 nt, artificial
  Chemically synthesized
ggaagaauccuccaaucag

SEQ ID NO: 301 - RNA, 19 nt, artificial
  Chemically synthesized
cguggauguaccgucauuu

SEQ ID NO: 302 - RNA, 19 nt, artificial
  Chemically synthesized
aaaaaaccggagagacuuu

SEQ ID NO: 303 - RNA, 19 nt, artificial
  Chemically synthesized
uuggcaucauuggaaaaaa

SEQ ID NO: 304 - RNA, 19 nt, artificial
  Chemically synthesized
caauaucauugacuccauu

SEQ ID NO: 305 - RNA, 19 nt, artificial
  Chemically synthesized
aaaucugagagcugcgaua

SEQ ID NO: 306 - RNA, 19 nt, artificial
  Chemically synthesized
agcaucugauaaugacaga

SEQ ID NO: 307 - RNA, 19 nt, artificial
  Chemically synthesized
aggagcucuuagugaccaa

SEQ ID NO: 308 - RNA, 19 nt, artificial
  Chemically synthesized
ggcauucucuguccuaccu

SEQ ID NO: 309 - RNA, 19 nt, artificial
  Chemically synthesized
gucaucugauccuucauau

SEQ ID NO: 310 - RNA, 19 nt, artificial
  Chemically synthesized
gaggcagcgagaaagcgca

SEQ ID NO: 311 - RNA, 19 nt, artificial
  Chemically synthesized
guaacaggcugcauuccca

SEQ ID NO: 312 - RNA, 19 nt, artificial
  Chemically synthesized
cauuagcaacagugaccua

SEQ ID NO: 313 - RNA, 19 nt, artificial
  Chemically synthesized
cauacuuuguggauggugu

SEQ ID NO: 314 - RNA, 19 nt, artificial
  Chemically synthesized
cggaagauaaugaacacca

SEQ ID NO: 315 - RNA, 19 nt, artificial
  Chemically synthesized
cagcugaucucaagagcaa

SEQ ID NO: 316 - RNA, 19 nt, artificial
  Chemically synthesized
ggugcuguuuuauaaacau

SEQ ID NO: 317 - RNA, 19 nt, artificial
  Chemically synthesized
ugaucugagcacuuuauau

SEQ ID NO: 318 - RNA, 19 nt, artificial
  Chemically synthesized
ucaagagcaacaaggcaaa

SEQ ID NO: 319 - RNA, 19 nt, artificial
  Chemically synthesized
cucccauuuccgucuuuuu

SEQ ID NO: 320 - RNA, 19 nt, artificial
  Chemically synthesized
agauaaccaugaucauaag

SEQ ID NO: 321 - RNA, 19 nt, artificial
  Chemically synthesized
gacuugcuuacuaaaacua

SEQ ID NO: 322 - RNA, 19 nt, artificial
  Chemically synthesized
ggaucuuuaaacuccauuc

SEQ ID NO: 323 - RNA, 19 nt, artificial
  Chemically synthesized
ugcucacucugaaaaacuu

SEQ ID NO: 324 - RNA, 19 nt, artificial
  Chemically synthesized
gucaguggccagaaaagau

SEQ ID NO: 325 - RNA, 19 nt, artificial
  Chemically synthesized
uggagauuuuuguagaugu

SEQ ID NO: 326 - RNA, 19 nt, artificial
  Chemically synthesized
ggcugcauucccaagacac

SEQ ID NO: 327 - RNA, 19 nt, artificial
  Chemically synthesized
agaauacuuggaucucagu

SEQ ID NO: 328 - RNA, 19 nt, artificial
  Chemically synthesized
gcagucuugaacauuuaga

SEQ ID NO: 329 - RNA, 19 nt, artificial
  Chemically synthesized
uggaucucagugaaaauuu

SEQ ID NO: 330 - RNA, 19 nt, artificial
  Chemically synthesized
auuuaagaccagucuuugu

SEQ ID NO: 331 - RNA, 19 nt, artificial
  Chemically synthesized
ucacaguagaaaacaguaa

SEQ ID NO: 332 - RNA, 19 nt, artificial
  Chemically synthesized
gguggagaaccuuaugguc

SEQ ID NO: 333 - RNA, 19 nt, artificial
  Chemically synthesized
caccuacauuagcaacagu

SEQ ID NO: 334 - RNA, 19 nt, artificial
  Chemically synthesized
accgcaaugguaucugcaa

SEQ ID NO: 335 - RNA, 19 nt, artificial
  Chemically synthesized
agucaauucagaauguaag

SEQ ID NO: 336 - RNA, 19 nt, artificial
  Chemically synthesized
aguugggaucuuuauguca

SEQ ID NO: 337 - RNA, 19 nt, artificial
  Chemically synthesized
cauucuucuggagcccauu

SEQ ID NO: 338 - RNA, 19 nt, artificial
  Chemically synthesized
cuuguugcuauuccuagaa

SEQ ID NO: 339 - RNA, 19 nt, artificial
  Chemically synthesized
cucugucuugugaccgcaa

SEQ ID NO: 340 - RNA, 19 nt, artificial
  Chemically synthesized
gaggacuugcuuacuaaaa

SEQ ID NO: 341 - RNA, 19 nt, artificial
  Chemically synthesized
auccaauggaauuaacaca

SEQ ID NO: 342 - RNA, 19 nt, artificial
  Chemically synthesized
cuaugaugcauuuguuucu

SEQ ID NO: 343 - RNA, 19 nt, artificial
  Chemically synthesized
gccugaaacuugucagugg

SEQ ID NO: 344 - RNA, 19 nt, artificial
  Chemically synthesized
cugcaagcugcggaagaua

SEQ ID NO: 345 - RNA, 19 nt, artificial
  Chemically synthesized
gggaauugguugcaggauc

SEQ ID NO: 346 - RNA, 19 nt, artificial
  Chemically synthesized
agguaaaguggaaacguua

SEQ ID NO: 347 - RNA, 19 nt, artificial
  Chemically synthesized
gaacugcgagauacugauu

SEQ ID NO: 348 - RNA, 19 nt, artificial
  Chemically synthesized
gaacauuuagacuuauccu

SEQ ID NO: 349 - RNA, 19 nt, artificial
  Chemically synthesized
aucacaguagaaaacagua

SEQ ID NO: 350 - RNA, 19 nt, artificial
  Chemically synthesized
ccaguguuugguguugcaa

SEQ ID NO: 351 - RNA, 19 nt, artificial
  Chemically synthesized
gaguggugcaaguaugaac

SEQ ID NO: 352 - RNA, 19 nt, artificial
  Chemically synthesized
caguguuugguguugcaag

SEQ ID NO: 353 - RNA, 19 nt, artificial
  Chemically synthesized
gugcuguguauuuccuauu

SEQ ID NO: 354 - RNA, 19 nt, artificial
  Chemically synthesized
caguggccagaaaagauga

SEQ ID NO: 355 - RNA, 19 nt, artificial
  Chemically synthesized
cauucuaugccugaaacuu

SEQ ID NO: 356 - RNA, 19 nt, artificial
  Chemically synthesized
uucacacacugaagacuuu

SEQ ID NO: 357 - RNA, 19 nt, artificial
  Chemically synthesized
uccugagagugggaaauau

SEQ ID NO: 358 - RNA, 19 nt, artificial
  Chemically synthesized
gcgauaaaguccuagguuc

SEQ ID NO: 359 - RNA, 19 nt, artificial
  Chemically synthesized
cugguaguuguggguugaa

SEQ ID NO: 360 - RNA, 19 nt, artificial
  Chemically synthesized
aggagcaacuugacucauu

SEQ ID NO: 361 - RNA, 19 nt, artificial
  Chemically synthesized
ccaaagucuugauugauug

SEQ ID NO: 362 - RNA, 19 nt, artificial
  Chemically synthesized
cuuaauggaguugguaauu

SEQ ID NO: 363 - RNA, 19 nt, artificial
  Chemically synthesized
cauucccaagacacuggaa

SEQ ID NO: 364 - RNA, 19 nt, artificial
  Chemically synthesized
cauuagaauacuuggaucu

SEQ ID NO: 365 - RNA, 19 nt, artificial
  Chemically synthesized
uccuuguuuacuuucacaa

SEQ ID NO: 366 - RNA, 19 nt, artificial
  Chemically synthesized
ccacaguugguugacuuca

SEQ ID NO: 367 - RNA, 19 nt, artificial
  Chemically synthesized
gccucucggugucggaaug

SEQ ID NO: 368 - RNA, 19 nt, artificial
  Chemically synthesized
caauagaggaagauucuuu

SEQ ID NO: 369 - RNA, 19 nt, artificial
  Chemically synthesized
agccuugaccuguccaaca

SEQ ID NO: 370 - RNA, 19 nt, artificial
  Chemically synthesized
ugaggaacuugagauugau

SEQ ID NO: 371 - RNA, 19 nt, artificial
  Chemically synthesized
caggagcuggagaacuuca

SEQ ID NO: 372 - RNA, 19 nt, artificial
  Chemically synthesized
uggccaaagucuugauuga

SEQ ID NO: 373 - RNA, 19 nt, artificial
  Chemically synthesized
gacuuaccuuccuugagga

SEQ ID NO: 374 - RNA, 19 nt, artificial
  Chemically synthesized
gguaguuguggguugaagc

SEQ ID NO: 375 - RNA, 19 nt, artificial
  Chemically synthesized
ugcuggagauuuuuguaga

SEQ ID NO: 376 - RNA, 19 nt, artificial
  Chemically synthesized
gaagcugguggcaauaacu

SEQ ID NO: 377 - RNA, 19 nt, artificial
  Chemically synthesized
cccauuuccgucuuuuuga

SEQ ID NO: 378 - RNA, 19 nt, artificial
  Chemically synthesized
agccucuccaaggaagaau

SEQ ID NO: 379 - RNA, 19 nt, artificial
  Chemically synthesized
agggcucacagaagcugua

SEQ ID NO: 380 - RNA, 19 nt, artificial
  Chemically synthesized
aaaacuuugugaagaguga

SEQ ID NO: 381 - RNA, 19 nt, artificial
  Chemically synthesized
acuguaaucuguagcaacu

SEQ ID NO: 382 - RNA, 19 nt, artificial
  Chemically synthesized
auauuuuacugcuggagau

SEQ ID NO: 383 - RNA, 19 nt, artificial
  Chemically synthesized
cuaccuagcugucacuucu

SEQ ID NO: 384 - RNA, 19 nt, artificial
  Chemically synthesized
agucaucugauccuucaua

SEQ ID NO: 385 - RNA, 19 nt, artificial
  Chemically synthesized
gaauguaagucaucugauc

SEQ ID NO: 386 - RNA, 19 nt, artificial
  Chemically synthesized
gcccauugcucuuucacug

SEQ ID NO: 387 - RNA, 19 nt, artificial
  Chemically synthesized
uccaauggaauuaacacaa

SEQ ID NO: 388 - RNA, 19 nt, artificial
  Chemically synthesized
gaagaauccuccaaucagg

SEQ ID NO: 389 - RNA, 19 nt, artificial
  Chemically synthesized
gauccucguggauaucaaa

SEQ ID NO: 390 - RNA, 19 nt, artificial
  Chemically synthesized
gauacugauuuggacacuu

SEQ ID NO: 391 - RNA, 19 nt, artificial
  Chemically synthesized
ccauuuccgucuuuuugau

SEQ ID NO: 392 - RNA, 19 nt, artificial
  Chemically synthesized
ggagagacuuugcucacuc

SEQ ID NO: 393 - RNA, 19 nt, artificial
  Chemically synthesized
cuucacuaagauucaaaga

SEQ ID NO: 394 - RNA, 19 nt, artificial
  Chemically synthesized
gguugacuucauggaugca

SEQ ID NO: 395 - RNA, 19 nt, artificial
  Chemically synthesized
cuuugaauuugccgcaacu

SEQ ID NO: 396 - RNA, 19 nt, artificial
  Chemically synthesized
accaugaucauaagucuau

SEQ ID NO: 397 - RNA, 19 nt, artificial
  Chemically synthesized
cuugguauccaagggaauu

SEQ ID NO: 398 - RNA, 19 nt, artificial
  Chemically synthesized
cuuaguucauuaggaaaca

SEQ ID NO: 399 - RNA, 19 nt, artificial
  Chemically synthesized
guuacaaguuccguggaau

SEQ ID NO: 400 - RNA, 19 nt, artificial
  Chemically synthesized
ggcaaaaucauuuggcauc

SEQ ID NO: 401 - RNA, 19 nt, artificial
  Chemically synthesized
agauguuagcaacaacaau

SEQ ID NO: 402 - RNA, 19 nt, artificial
  Chemically synthesized
gaaaaaagugcuguguauu

SEQ ID NO: 403 - RNA, 19 nt, artificial
  Chemically synthesized
guugguaauuuuagagcau

SEQ ID NO: 404 - RNA, 19 nt, artificial
  Chemically synthesized
cgccucucggugucggaau

SEQ ID NO: 405 - RNA, 19 nt, artificial
  Chemically synthesized
cauugcucuuucacugcuu

SEQ ID NO: 406 - RNA, 19 nt, artificial
  Chemically synthesized
agaauuagaguuugaugac

SEQ ID NO: 407 - RNA, 19 nt, artificial
  Chemically synthesized
ggccaaagucuugauugau

SEQ ID NO: 408 - RNA, 19 nt, artificial
  Chemically synthesized
ggaauguuuggaacugcga

SEQ ID NO: 409 - RNA, 19 nt, artificial
  Chemically synthesized
caauccggaggcugcauau

SEQ ID NO: 410 - RNA, 19 nt, artificial
  Chemically synthesized
aggcucagcgggaaggauu

SEQ ID NO: 411 - RNA, 19 nt, artificial
  Chemically synthesized
gcuauuccuagaaaaaagu

SEQ ID NO: 412 - RNA, 19 nt, artificial
  Chemically synthesized
ggcagucuugaacauuuag

SEQ ID NO: 413 - RNA, 19 nt, artificial
  Chemically synthesized
acagcacaaaugaacuuaa

SEQ ID NO: 414 - RNA, 19 nt, artificial
  Chemically synthesized
cauuggaaaaaaccggaga

SEQ ID NO: 415 - RNA, 19 nt, artificial
  Chemically synthesized
gcacacgaauacacagugu

SEQ ID NO: 416 - RNA, 19 nt, artificial
  Chemically synthesized
agaccuauagugacuccca

SEQ ID NO: 417 - RNA, 19 nt, artificial
  Chemically synthesized
ggauguaccgucauuugag

SEQ ID NO: 418 - RNA, 19 nt, artificial
  Chemically synthesized
ugggaaauauggacaccuu

SEQ ID NO: 419 - RNA, 19 nt, artificial
  Chemically synthesized
aguggugcaaguaugaacu

SEQ ID NO: 420 - RNA, 19 nt, artificial
  Chemically synthesized
ugcugacauccaauggaau

SEQ ID NO: 421 - RNA, 19 nt, artificial
  Chemically synthesized
ggcaugugcugugcucugu

SEQ ID NO: 422 - RNA, 19 nt, artificial
  Chemically synthesized
agaaucacaguagaaaaca

SEQ ID NO: 423 - RNA, 19 nt, artificial
  Chemically synthesized
cuucuggagcccauugaga

SEQ ID NO: 424 - RNA, 19 nt, artificial
  Chemically synthesized
cucggaguucucccagugu

SEQ ID NO: 425 - RNA, 19 nt, artificial
  Chemically synthesized
acaccaagaccuaccugga

SEQ ID NO: 426 - RNA, 19 nt, artificial
  Chemically synthesized
gagcugcgauaaaguccua

SEQ ID NO: 427 - RNA, 19 nt, artificial
  Chemically synthesized
ccuuccuugaggaacuuga

SEQ ID NO: 428 - RNA, 19 nt, artificial
  Chemically synthesized
gaccuacagagguguguga

SEQ ID NO: 429 - RNA, 19 nt, artificial
  Chemically synthesized
aucugagagcugcgauaaa

SEQ ID NO: 430 - RNA, 19 nt, artificial
  Chemically synthesized
ucugauaaugacagaguua

SEQ ID NO: 431 - RNA, 19 nt, artificial
  Chemically synthesized
aaucaguaggaaugcaaua

SEQ ID NO: 432 - RNA, 19 nt, artificial
  Chemically synthesized
gagcccauugagaaaaaag

SEQ ID NO: 433 - RNA, 19 nt, artificial
  Chemically synthesized
uuaugaucugagcacuuua

SEQ ID NO: 434 - RNA, 19 nt, artificial
  Chemically synthesized
acagagcuaugagccaaaa

SEQ ID NO: 435 - RNA, 19 nt, artificial
  Chemically synthesized
cuuuuugaugagaacaaug

SEQ ID NO: 436 - RNA, 19 nt, artificial
  Chemically synthesized
gcucggaguucucccagug

SEQ ID NO: 437 - RNA, 19 nt, artificial
  Chemically synthesized
gggaaauccuuacaaaacc

SEQ ID NO: 438 - RNA, 19 nt, artificial
  Chemically synthesized
ugaagucaauucagaaugu

SEQ ID NO: 439 - RNA, 19 nt, artificial
  Chemically synthesized
acguggauguaccgucauu

SEQ ID NO: 440 - RNA, 19 nt, artificial
  Chemically synthesized
uuucuaaggagcaacuuga

SEQ ID NO: 441 - RNA, 19 nt, artificial
  Chemically synthesized
ccuucacuaagauucaaag

SEQ ID NO: 442 - RNA, 19 nt, artificial
  Chemically synthesized
acugguaguuguggguuga

SEQ ID NO: 443 - RNA, 19 nt, artificial
  Chemically synthesized
aaauccugagagugggaaa

SEQ ID NO: 444 - RNA, 19 nt, artificial
  Chemically synthesized
ggagaaccuuaugguccag

SEQ ID NO: 445 - RNA, 19 nt, artificial
  Chemically synthesized
aauacuuggaucucaguga

SEQ ID NO: 446 - RNA, 19 nt, artificial
  Chemically synthesized
gcauucucuguccuaccua

SEQ ID NO: 447 - RNA, 19 nt, artificial
  Chemically synthesized
ccauucucauucuucugga

SEQ ID NO: 448 - RNA, 19 nt, artificial
  Chemically synthesized
gaaucagauuucuggauug

SEQ ID NO: 449 - RNA, 19 nt, artificial
  Chemically synthesized
ugaugagaacaaugaugcu

SEQ ID NO: 450 - RNA, 19 nt, artificial
  Chemically synthesized
ugaauauagucccuuggua

SEQ ID NO: 451 - RNA, 19 nt, artificial
  Chemically synthesized
cguuuucuaaggagcaacu

SEQ ID NO: 452 - RNA, 19 nt, artificial
  Chemically synthesized
uucccaagacacuggaaau

SEQ ID NO: 453 - RNA, 19 nt, artificial
  Chemically synthesized
agauccagguaaaguggaa

SEQ ID NO: 454 - RNA, 19 nt, artificial
  Chemically synthesized
ugcauauuccaagguuuua

SEQ ID NO: 455 - RNA, 19 nt, artificial
  Chemically synthesized
cagucuugaacauuuagac

SEQ ID NO: 456 - RNA, 19 nt, artificial
  Chemically synthesized
ccgaugaaaguuuguuuca

SEQ ID NO: 457 - RNA, 19 nt, artificial
  Chemically synthesized
gacugugucauucuuucuu

SEQ ID NO: 458 - RNA, 19 nt, artificial
  Chemically synthesized
cuucauaagcgggacuuca

SEQ ID NO: 459 - RNA, 19 nt, artificial
  Chemically synthesized
uuuucugguuccuuguuua

SEQ ID NO: 460 - RNA, 19 nt, artificial
  Chemically synthesized
ccuucauaugaagcagcau

SEQ ID NO: 461 - RNA, 19 nt, artificial
  Chemically synthesized
ucauugacuccauugaaaa

SEQ ID NO: 462 - RNA, 19 nt, artificial
  Chemically synthesized
ccugagagugggaaauaug

SEQ ID NO: 463 - RNA, 19 nt, artificial
  Chemically synthesized
aucaguaggaaugcaauaa

SEQ ID NO: 464 - RNA, 19 nt, artificial
  Chemically synthesized
augagauaaccaugaucau

SEQ ID NO: 465 - RNA, 19 nt, artificial
  Chemically synthesized
cauauuuuacugcuggaga

SEQ ID NO: 466 - RNA, 19 nt, artificial
  Chemically synthesized
uccuagguucccauauuua

SEQ ID NO: 467 - RNA, 19 nt, artificial
  Chemically synthesized
cuugugaccgcaaugguau

SEQ ID NO: 468 - RNA, 19 nt, artificial
  Chemically synthesized
acaauaucauugacuccau

SEQ ID NO: 469 - RNA, 19 nt, artificial
  Chemically synthesized
cucuguuccugcugauccu

SEQ ID NO: 470 - RNA, 19 nt, artificial
  Chemically synthesized
aggcaaaaucauuuggcau

SEQ ID NO: 471 - RNA, 19 nt, artificial
  Chemically synthesized
ucagauuucuggauuguua

SEQ ID NO: 472 - RNA, 19 nt, artificial
  Chemically synthesized
gugugacucuccaucccau

SEQ ID NO: 473 - RNA, 19 nt, artificial
  Chemically synthesized
cauucucuguccuaccuag

SEQ ID NO: 474 - RNA, 19 nt, artificial
  Chemically synthesized
ugaggacuugcuuacuaaa

SEQ ID NO: 475 - RNA, 19 nt, artificial
  Chemically synthesized
ggguaaaucugagagcugc

SEQ ID NO: 476 - RNA, 19 nt, artificial
  Chemically synthesized
ugcuaugaugcauuuguuu

SEQ ID NO: 477 - RNA, 19 nt, artificial
  Chemically synthesized
agcauauuuuacugcugga

SEQ ID NO: 478 - RNA, 19 nt, artificial
  Chemically synthesized
aguaggaaugcaauaacua

SEQ ID NO: 479 - RNA, 19 nt, artificial
  Chemically synthesized
aacuuauccagcacacgaa

SEQ ID NO: 480 - RNA, 19 nt, artificial
  Chemically synthesized
gcgagauacugauuuggac

SEQ ID NO: 481 - RNA, 19 nt, artificial
  Chemically synthesized
aaggcaaaaucauuuggca

SEQ ID NO: 482 - RNA, 19 nt, artificial
  Chemically synthesized
ccguggaauguuuggaacu

SEQ ID NO: 483 - RNA, 19 nt, artificial
  Chemically synthesized
cuuugucuaguugggaucu

SEQ ID NO: 484 - RNA, 19 nt, artificial
  Chemically synthesized
agaggugugugaaccucca

SEQ ID NO: 485 - RNA, 19 nt, artificial
  Chemically synthesized
cagaauguaagucaucuga

SEQ ID NO: 486 - RNA, 19 nt, artificial
  Chemically synthesized
cucacucugaaaaacuuga

SEQ ID NO: 487 - RNA, 19 nt, artificial
  Chemically synthesized
cuaugagccaaaaaguuug

SEQ ID NO: 488 - RNA, 19 nt, artificial
  Chemically synthesized
cuuucugaaaacuuuguga

SEQ ID NO: 489 - RNA, 19 nt, artificial
  Chemically synthesized
ggcguucucucaggugacu

SEQ ID NO: 490 - RNA, 19 nt, artificial
  Chemically synthesized
uccaggagcuggagaacuu

SEQ ID NO: 491 - RNA, 19 nt, artificial
  Chemically synthesized
gugucggaaugucacagga

SEQ ID NO: 492 - RNA, 19 nt, artificial
  Chemically synthesized
uucacuuacagaaagaguu

SEQ ID NO: 493 - RNA, 19 nt, artificial
  Chemically synthesized
aggaaacagcacaaaugaa

SEQ ID NO: 494 - RNA, 19 nt, artificial
  Chemically synthesized
uuccuuguuuacuuucaca

SEQ ID NO: 495 - RNA, 19 nt, artificial
  Chemically synthesized
gugaagagugaguggugca

SEQ ID NO: 496 - RNA, 19 nt, artificial
  Chemically synthesized
ucucaaugacugugucauu

SEQ ID NO: 497 - RNA, 19 nt, artificial
  Chemically synthesized
auuuggcaucauuggaaaa

SEQ ID NO: 498 - RNA, 19 nt, artificial
  Chemically synthesized
caacuguaaucuguagcaa

SEQ ID NO: 499 - RNA, 19 nt, artificial
  Chemically synthesized
gcugaucucaagagcaaca

SEQ ID NO: 500 - RNA, 19 nt, artificial
  Chemically synthesized
uggccugugguauaugaaa

SEQ ID NO: 501 - RNA, 19 nt, artificial
  Chemically synthesized
ucuaugagauaaccaugau

SEQ ID NO: 502 - RNA, 19 nt, artificial
  Chemically synthesized
ggcucauugugcccauugc

SEQ ID NO: 503 - RNA, 19 nt, artificial
  Chemically synthesized
guggcaauaacuucauuug

SEQ ID NO: 504 - RNA, 19 nt, artificial
  Chemically synthesized
guuccuuguuuacuuucac

SEQ ID NO: 505 - RNA, 19 nt, artificial
  Chemically synthesized
acauccaauggaauuaaca

SEQ ID NO: 506 - RNA, 19 nt, artificial
  Chemically synthesized
caaguugugucuucauaag

SEQ ID NO: 507 - RNA, 19 nt, artificial
  Chemically synthesized
cuuugugcuuucugaaaac

SEQ ID NO: 508 - RNA, 19 nt, artificial
  Chemically synthesized
agcaacuugacucauuuca

SEQ ID NO: 509 - RNA, 19 nt, artificial
  Chemically synthesized
gcagcugaucucaagagca

SEQ ID NO: 510 - RNA, 19 nt, artificial
  Chemically synthesized
gcuucagaucuacagagcu

SEQ ID NO: 511 - RNA, 19 nt, artificial
  Chemically synthesized
gauccacaguugguugacu

SEQ ID NO: 512 - RNA, 19 nt, artificial
  Chemically synthesized
agaauguaagucaucugau

SEQ ID NO: 513 - RNA, 19 nt, artificial
  Chemically synthesized
uggacaccuucacuaagau

SEQ ID NO: 514 - RNA, 19 nt, artificial
  Chemically synthesized
cugccauucucauucuucu

SEQ ID NO: 515 - RNA, 19 nt, artificial
  Chemically synthesized
agaacaaugaugcugccau

SEQ ID NO: 516 - RNA, 19 nt, artificial
  Chemically synthesized
aaggagaccuauagugacu

SEQ ID NO: 517 - RNA, 19 nt, artificial
  Chemically synthesized
guauugaaaaucaguagga

SEQ ID NO: 518 - RNA, 19 nt, artificial
  Chemically synthesized
aggaagaauccuccaauca

SEQ ID NO: 519 - RNA, 19 nt, artificial
  Chemically synthesized
ccuccaaucaggcuucucu

SEQ ID NO: 520 - RNA, 19 nt, artificial
  Chemically synthesized
uacuuggaucucagugaaa

SEQ ID NO: 521 - RNA, 19 nt, artificial
  Chemically synthesized
uguuuggaacugcgagaua

SEQ ID NO: 522 - RNA, 19 nt, artificial
  Chemically synthesized
aaucugagagcugcgauaa

SEQ ID NO: 523 - RNA, 19 nt, artificial
  Chemically synthesized
gcucuggugcugacaucca

SEQ ID NO: 524 - RNA, 19 nt, artificial
  Chemically synthesized
cuucaaguugugucuucau

SEQ ID NO: 525 - RNA, 19 nt, artificial
  Chemically synthesized
caucagccucuccaaggaa

SEQ ID NO: 526 - RNA, 19 nt, artificial
  Chemically synthesized
gcaugugcugugcucuguu

SEQ ID NO: 527 - RNA, 19 nt, artificial
  Chemically synthesized
ccgcaaugguaucugcaag

SEQ ID NO: 528 - RNA, 19 nt, artificial
  Chemically synthesized
gugcuuucugaaaacuuug

SEQ ID NO: 529 - RNA, 19 nt, artificial
  Chemically synthesized
ggcggcugcucggcguucu

SEQ ID NO: 530 - RNA, 19 nt, artificial
  Chemically synthesized
caggugacugcucggaguu

SEQ ID NO: 531 - RNA, 19 nt, artificial
  Chemically synthesized
uugacuucauggaugcaga

SEQ ID NO: 532 - RNA, 19 nt, artificial
  Chemically synthesized
ccauggauauagagggcca

SEQ ID NO: 533 - RNA, 19 nt, artificial
  Chemically synthesized
augcagaacccauggauau

SEQ ID NO: 534 - RNA, 19 nt, artificial
  Chemically synthesized
gaaaaucaguaggaaugca

SEQ ID NO: 535 - RNA, 19 nt, artificial
  Chemically synthesized
acaucugcuaugaugcauu

SEQ ID NO: 536 - RNA, 19 nt, artificial
  Chemically synthesized
auccacaguugguugacuu

SEQ ID NO: 537 - RNA, 19 nt, artificial
  Chemically synthesized
aacuggacuucucccauuu

SEQ ID NO: 538 - RNA, 19 nt, artificial
  Chemically synthesized
uccgucuuuuugaugagaa

SEQ ID NO: 539 - RNA, 19 nt, artificial
  Chemically synthesized
ugguaauuuuagagcaucu

SEQ ID NO: 540 - RNA, 19 nt, artificial
  Chemically synthesized
ggaaacaucucuuuuuucu

SEQ ID NO: 541 - RNA, 19 nt, artificial
  Chemically synthesized
uacagagcuaugagccaaa

SEQ ID NO: 542 - RNA, 19 nt, artificial
  Chemically synthesized
augguugaagaauacuuga

SEQ ID NO: 543 - RNA, 19 nt, artificial
  Chemically synthesized
agcacaaaugaacuuaaga

SEQ ID NO: 544 - RNA, 19 nt, artificial
  Chemically synthesized
cccauauuuaagaccaguc

SEQ ID NO: 545 - RNA, 19 nt, artificial
  Chemically synthesized
ccugcuaagagacuccucu

SEQ ID NO: 546 - RNA, 19 nt, artificial
  Chemically synthesized
ugagcacuuuauauucacu

SEQ ID NO: 547 - RNA, 19 nt, artificial
  Chemically synthesized
gcacuuuauauucacuuac

SEQ ID NO: 548 - RNA, 19 nt, artificial
  Chemically synthesized
auuagaguuugaugacugu

SEQ ID NO: 549 - RNA, 19 nt, artificial
  Chemically synthesized
gaauccuccaaucaggcuu

SEQ ID NO: 550 - RNA, 19 nt, artificial
  Chemically synthesized
augugaaaaucaccgauga

SEQ ID NO: 551 - RNA, 19 nt, artificial
  Chemically synthesized
caggauccaaaggagaccu

SEQ ID NO: 552 - RNA, 19 nt, artificial
  Chemically synthesized
guauccaagggaauugguu

SEQ ID NO: 553 - RNA, 19 nt, artificial
  Chemically synthesized
cuuuuuucucaucucacaa

SEQ ID NO: 554 - RNA, 19 nt, artificial
  Chemically synthesized
guaauuuuagagcaucuga

SEQ ID NO: 555 - RNA, 19 nt, artificial
  Chemically synthesized
guuuggaacugcgagauac

SEQ ID NO: 556 - RNA, 19 nt, artificial
  Chemically synthesized
cacugaagacuuuggaagc

SEQ ID NO: 557 - RNA, 19 nt, artificial
  Chemically synthesized
ugcggaagauaaugaacac

SEQ ID NO: 558 - RNA, 19 nt, artificial
  Chemically synthesized
caucugauaaugacagagu

SEQ ID NO: 559 - RNA, 19 nt, artificial
  Chemically synthesized
acaaaauugcaaauccuga

SEQ ID NO: 560 - RNA, 19 nt, artificial
  Chemically synthesized
aauugcaaauccugagagu

SEQ ID NO: 561 - RNA, 19 nt, artificial
  Chemically synthesized
cacuggaaauuuuagaugu

SEQ ID NO: 562 - RNA, 19 nt, artificial
  Chemically synthesized
uacguuuucuaaggagcaa

SEQ ID NO: 563 - RNA, 19 nt, artificial
  Chemically synthesized
accaagaccuaccuggagu

SEQ ID NO: 564 - RNA, 19 nt, artificial
  Chemically synthesized
guugguugacuucauggau

SEQ ID NO: 565 - RNA, 19 nt, artificial
  Chemically synthesized
uucuaugagauaaccauga

SEQ ID NO: 566 - RNA, 19 nt, artificial
  Chemically synthesized
ccagcaggaacaucugcua

SEQ ID NO: 567 - RNA, 19 nt, artificial
  Chemically synthesized
caguaaaguuuuucugguu

SEQ ID NO: 568 - RNA, 19 nt, artificial
  Chemically synthesized
gagcacuuuauauucacuu

SEQ ID NO: 569 - RNA, 19 nt, artificial
  Chemically synthesized
uucauuugcuccugugaau

SEQ ID NO: 570 - RNA, 19 nt, artificial
  Chemically synthesized
accuuaugguccaggagcu

SEQ ID NO: 571 - RNA, 19 nt, artificial
  Chemically synthesized
agaaccuuaugguccagga

SEQ ID NO: 572 - RNA, 19 nt, artificial
  Chemically synthesized
uuuggaagcugguggcaau

SEQ ID NO: 573 - RNA, 19 nt, artificial
  Chemically synthesized
uugaggacuugcuuacuaa

SEQ ID NO: 574 - RNA, 19 nt, artificial
  Chemically synthesized
auacugauuuggacacuuu

SEQ ID NO: 575 - RNA, 19 nt, artificial
  Chemically synthesized
cacaauagaggaagauucu

SEQ ID NO: 576 - RNA, 19 nt, artificial
  Chemically synthesized
cuaguugggaucuuuaugu

SEQ ID NO: 577 - RNA, 19 nt, artificial
  Chemically synthesized
ccauugaaaagagccacaa

SEQ ID NO: 578 - RNA, 19 nt, artificial
  Chemically synthesized
cucauuucacacacugaag

SEQ ID NO: 579 - RNA, 19 nt, artificial
  Chemically synthesized
aaaucaguaggaaugcaau

SEQ ID NO: 580 - RNA, 19 nt, artificial
  Chemically synthesized
agcucuuagugaccaagug

SEQ ID NO: 581 - RNA, 19 nt, artificial
  Chemically synthesized
aguucauuaggaaacagca

SEQ ID NO: 582 - RNA, 19 nt, artificial
  Chemically synthesized
ggacacuuuccauuuuuca

SEQ ID NO: 583 - RNA, 19 nt, artificial
  Chemically synthesized
ccuuucuucuuuaacauuc

SEQ ID NO: 584 - RNA, 19 nt, artificial
  Chemically synthesized
ugauugauuggccagcaaa

SEQ ID NO: 585 - RNA, 19 nt, artificial
  Chemically synthesized
gaacuuauccagcacacga

SEQ ID NO: 586 - RNA, 19 nt, artificial
  Chemically synthesized
acuguacccuuaauggagu

SEQ ID NO: 587 - RNA, 19 nt, artificial
  Chemically synthesized
aagauaaugaacaccaaga

SEQ ID NO: 588 - RNA, 19 nt, artificial
  Chemically synthesized
ccaagaccuaccuggagug

SEQ ID NO: 589 - RNA, 19 nt, artificial
  Chemically synthesized
ucacaaaauugcaaauccu

SEQ ID NO: 590 - RNA, 19 nt, artificial
  Chemically synthesized
ucauuugaggacuugcuua

SEQ ID NO: 591 - RNA, 19 nt, artificial
  Chemically synthesized
ugggaucuuuaugucacua

SEQ ID NO: 592 - RNA, 19 nt, artificial
  Chemically synthesized
gcugcucggcguucucuca

SEQ ID NO: 593 - RNA, 19 nt, artificial
  Chemically synthesized
uccagaaauaaguugauga

SEQ ID NO: 594 - RNA, 19 nt, artificial
  Chemically synthesized
ugugaaaaucaccgaugaa

SEQ ID NO: 595 - RNA, 19 nt, artificial
  Chemically synthesized
ccagucuuugucuaguugg

SEQ ID NO: 596 - RNA, 19 nt, artificial
  Chemically synthesized
agagcuaugagccaaaaag

SEQ ID NO: 597 - RNA, 19 nt, artificial
  Chemically synthesized
uaaccaugaucauaagucu

SEQ ID NO: 598 - RNA, 19 nt, artificial
  Chemically synthesized
gugaauuccucuccuucac

SEQ ID NO: 599 - RNA, 19 nt, artificial
  Chemically synthesized
gguauaugaaaaugaugug

SEQ ID NO: 600 - RNA, 19 nt, artificial
  Chemically synthesized
ccuucacucaggagcagca

SEQ ID NO: 601 - RNA, 19 nt, artificial
  Chemically synthesized
cuugaccuguccaacaaca

SEQ ID NO: 602 - RNA, 19 nt, artificial
  Chemically synthesized
cuggugaaacaaauucauu

SEQ ID NO: 603 - RNA, 19 nt, artificial
  Chemically synthesized
agagugaguggugcaagua

SEQ ID NO: 604 - RNA, 19 nt, artificial
  Chemically synthesized
uggccagaaaagaugaaau

SEQ ID NO: 605 - RNA, 19 nt, artificial
  Chemically synthesized
ccaacuguaaucuguagca

SEQ ID NO: 606 - RNA, 19 nt, artificial
  Chemically synthesized
acuucucugugcagcugau

SEQ ID NO: 607 - RNA, 19 nt, artificial
  Chemically synthesized
ugguggcaauaacuucauu

SEQ ID NO: 608 - RNA, 19 nt, artificial
  Chemically synthesized
ucauuuggcaucauuggaa

SEQ ID NO: 609 - RNA, 19 nt, artificial
  Chemically synthesized
cuggguggagaaccuuaug

SEQ ID NO: 610 - RNA, 19 nt, artificial
  Chemically synthesized
auccacuggugaaacaaau

SEQ ID NO: 611 - RNA, 19 nt, artificial
  Chemically synthesized
agucuuugucuaguuggga

SEQ ID NO: 612 - RNA, 19 nt, artificial
  Chemically synthesized
agcaacaacaaucucaauu

SEQ ID NO: 613 - RNA, 19 nt, artificial
  Chemically synthesized
ugccgcaacucaaagaacu

SEQ ID NO: 614 - RNA, 19 nt, artificial
  Chemically synthesized
agaguuauagauccaggua

SEQ ID NO: 615 - RNA, 19 nt, artificial
  Chemically synthesized
caaguggaucauugacaau

SEQ ID NO: 616 - RNA, 19 nt, artificial
  Chemically synthesized
ucuugugaccgcaauggua

SEQ ID NO: 617 - RNA, 19 nt, artificial
  Chemically synthesized
cugagagcugcgauaaagu

SEQ ID NO: 618 - RNA, 19 nt, artificial
  Chemically synthesized
cccuucaaguugugucuuc

SEQ ID NO: 619 - RNA, 19 nt, artificial
  Chemically synthesized
ggccaacuguaaucuguag

SEQ ID NO: 620 - RNA, 19 nt, artificial
  Chemically synthesized
gacauccaauggaauuaac

SEQ ID NO: 621 - RNA, 19 nt, artificial
  Chemically synthesized
gcaacuugacucauuucac

SEQ ID NO: 622 - RNA, 19 nt, artificial
  Chemically synthesized
aguuaaguucauucagaca

SEQ ID NO: 623 - RNA, 19 nt, artificial
  Chemically synthesized
gaaaaucaccgaugaaagu

SEQ ID NO: 624 - RNA, 19 nt, artificial
  Chemically synthesized
cucuguccuaccuagcugu

SEQ ID NO: 625 - RNA, 19 nt, artificial
  Chemically synthesized
cacuggacaaugccacaua

SEQ ID NO: 626 - RNA, 19 nt, artificial
  Chemically synthesized
auccugagagugggaaaua

SEQ ID NO: 627 - RNA, 19 nt, artificial
  Chemically synthesized
agcccauugagaaaaaagc

SEQ ID NO: 628 - RNA, 19 nt, artificial
  Chemically synthesized
agucuugaacauuuagacu

SEQ ID NO: 629 - RNA, 19 nt, artificial
  Chemically synthesized
uguggauggugugggucuu

SEQ ID NO: 630 - RNA, 19 nt, artificial
  Chemically synthesized
uauccacuggugaaacaaa

SEQ ID NO: 631 - RNA, 19 nt, artificial
  Chemically synthesized
acuugacucauuucacaca

SEQ ID NO: 632 - RNA, 19 nt, artificial
  Chemically synthesized
gaacaucugcuaugaugca

SEQ ID NO: 633 - RNA, 19 nt, artificial
  Chemically synthesized
agaggaagauucuuuuucu

SEQ ID NO: 634 - RNA, 19 nt, artificial
  Chemically synthesized
cuagguucccauauuuaag

SEQ ID NO: 635 - RNA, 19 nt, artificial
  Chemically synthesized
aaaucaccgaugaaaguuu

SEQ ID NO: 636 - RNA, 19 nt, artificial
  Chemically synthesized
gaggaagauucuuuuucuu

SEQ ID NO: 637 - RNA, 19 nt, artificial
  Chemically synthesized
ccacaaaacugucuuugug

SEQ ID NO: 638 - RNA, 19 nt, artificial
  Chemically synthesized
cuuaagauucucaaugacu

SEQ ID NO: 639 - RNA, 19 nt, artificial
  Chemically synthesized
cuccucuguggccacaaaa

SEQ ID NO: 640 - RNA, 19 nt, artificial
  Chemically synthesized
auuccuggcaaguggauca

SEQ ID NO: 641 - RNA, 19 nt, artificial
  Chemically synthesized
gugcucuguuccugcugau

SEQ ID NO: 642 - RNA, 19 nt, artificial
  Chemically synthesized
cuguccaacaacaggauca

SEQ ID NO: 643 - RNA, 19 nt, artificial
  Chemically synthesized
ccacaaaaggcauucucug

SEQ ID NO: 644 - RNA, 19 nt, artificial
  Chemically synthesized
ggacuucucccauuuccgu

SEQ ID NO: 645 - RNA, 19 nt, artificial
  Chemically synthesized
acugcucggaguucuccca

SEQ ID NO: 646 - RNA, 19 nt, artificial
  Chemically synthesized
agauuucuggauuguuaga

SEQ ID NO: 647 - RNA, 19 nt, artificial
  Chemically synthesized
gguccaggagcuggagaac

SEQ ID NO: 648 - RNA, 19 nt, artificial
  Chemically synthesized
cauugugcccauugcucuu

SEQ ID NO: 649 - RNA, 19 nt, artificial
  Chemically synthesized
caaaaucauuuggcaucau

SEQ ID NO: 650 - RNA, 19 nt, artificial
  Chemically synthesized
uaugagauaaccaugauca

SEQ ID NO: 651 - RNA, 19 nt, artificial
  Chemically synthesized
gagcucuuagugaccaagu

SEQ ID NO: 652 - RNA, 19 nt, artificial
  Chemically synthesized
gcugucacuucucugugca

SEQ ID NO: 653 - RNA, 19 nt, artificial
  Chemically synthesized
ggaauugguugcaggaucc

SEQ ID NO: 654 - RNA, 19 nt, artificial
  Chemically synthesized
ggacuuaccuuccuugagg

SEQ ID NO: 655 - RNA, 19 nt, artificial
  Chemically synthesized
accagaugccucccucuua

SEQ ID NO: 656 - RNA, 19 nt, artificial
  Chemically synthesized
aguugguugacuucaugga

SEQ ID NO: 657 - RNA, 19 nt, artificial
  Chemically synthesized
uuagcaacaacaaucucaa

SEQ ID NO: 658 - RNA, 19 nt, artificial
  Chemically synthesized
agugaaaauuugaugguug

SEQ ID NO: 659 - RNA, 19 nt, artificial
  Chemically synthesized
cuggacuuaccuuccuuga

SEQ ID NO: 660 - RNA, 19 nt, artificial
  Chemically synthesized
ugaaaaauucagccuguga

SEQ ID NO: 661 - RNA, 19 nt, artificial
  Chemically synthesized
guggccagaaaagaugaaa

SEQ ID NO: 662 - RNA, 19 nt, artificial
  Chemically synthesized
cccucagggcucacagaag

SEQ ID NO: 663 - RNA, 19 nt, artificial
  Chemically synthesized
gaggcugcauauuccaagg

SEQ ID NO: 664 - RNA, 19 nt, artificial
  Chemically synthesized
ccgccucucggugucggaa

SEQ ID NO: 665 - RNA, 19 nt, artificial
  Chemically synthesized
gguauccaagggaauuggu

SEQ ID NO: 666 - RNA, 19 nt, artificial
  Chemically synthesized
gccagauuuaaaaauuggu

SEQ ID NO: 667 - RNA, 19 nt, artificial
  Chemically synthesized
cagaacuauccacugguga

SEQ ID NO: 668 - RNA, 19 nt, artificial
  Chemically synthesized
gucacuaguuauaguuaag

SEQ ID NO: 669 - RNA, 19 nt, artificial
  Chemically synthesized
uuagcaacagugaccuaca

SEQ ID NO: 670 - RNA, 19 nt, artificial
  Chemically synthesized
uacccuuaauggaguuggu

SEQ ID NO: 671 - RNA, 19 nt, artificial
  Chemically synthesized
uggauguaccgucauuuga

SEQ ID NO: 672 - RNA, 19 nt, artificial
  Chemically synthesized
cuuuccauuuuucagaacu

SEQ ID NO: 673 - RNA, 19 nt, artificial
  Chemically synthesized
agcaggauccaaaggagac

SEQ ID NO: 674 - RNA, 19 nt, artificial
  Chemically synthesized
ccucccucuuacccauguu

SEQ ID NO: 675 - RNA, 19 nt, artificial
  Chemically synthesized
cugaaaacuuugugaagag

SEQ ID NO: 676 - RNA, 19 nt, artificial
  Chemically synthesized
gcauucccaagacacugga

SEQ ID NO: 677 - RNA, 19 nt, artificial
  Chemically synthesized
ucaucucacaaaauugcaa

SEQ ID NO: 678 - RNA, 19 nt, artificial
  Chemically synthesized
agucuauuacugauaucug

SEQ ID NO: 679 - RNA, 19 nt, artificial
  Chemically synthesized
ucugaaaacuuugugaaga

SEQ ID NO: 680 - RNA, 19 nt, artificial
  Chemically synthesized
ggaacaucugcuaugaugc

SEQ ID NO: 681 - RNA, 19 nt, artificial
  Chemically synthesized
gauuucuggauuguuagaa

SEQ ID NO: 682 - RNA, 19 nt, artificial
  Chemically synthesized
agaguuugaugacuguacc

SEQ ID NO: 683 - RNA, 19 nt, artificial
  Chemically synthesized
ucuuuuuucucaucucaca

SEQ ID NO: 684 - RNA, 19 nt, artificial
  Chemically synthesized
ugaguggugcaaguaugaa

SEQ ID NO: 685 - RNA, 19 nt, artificial
  Chemically synthesized
acucugaaaaacuugacua

SEQ ID NO: 686 - RNA, 19 nt, artificial
  Chemically synthesized
cuuuguggauggugugggu

SEQ ID NO: 687 - RNA, 19 nt, artificial
  Chemically synthesized
cucccaguguuugguguug

SEQ ID NO: 688 - RNA, 19 nt, artificial
  Chemically synthesized
acuccucuguggccacaaa

SEQ ID NO: 689 - RNA, 19 nt, artificial
  Chemically synthesized
acugcuggagauuuuugua

SEQ ID NO: 690 - RNA, 19 nt, artificial
  Chemically synthesized
acuuacugggaaauccuua

SEQ ID NO: 691 - RNA, 19 nt, artificial
  Chemically synthesized
ugcuggacuuaccuuccuu

SEQ ID NO: 692 - RNA, 19 nt, artificial
  Chemically synthesized
aauguuuggaacugcgaga

SEQ ID NO: 693 - RNA, 19 nt, artificial
  Chemically synthesized
acccuuaauggaguuggua

SEQ ID NO: 694 - RNA, 19 nt, artificial
  Chemically synthesized
cugcuuucaacugguaguu

SEQ ID NO: 695 - RNA, 19 nt, artificial
  Chemically synthesized
accagucuuugucuaguug

SEQ ID NO: 696 - RNA, 19 nt, artificial
  Chemically synthesized
gggaucuuuaugucacuag

SEQ ID NO: 697 - RNA, 19 nt, artificial
  Chemically synthesized
aaaagauuuugcuggacuu

SEQ ID NO: 698 - RNA, 19 nt, artificial
  Chemically synthesized
gcucauugugcccauugcu

SEQ ID NO: 699 - RNA, 19 nt, artificial
  Chemically synthesized
ucaucagccucuccaagga

SEQ ID NO: 700 - RNA, 19 nt, artificial
  Chemically synthesized
aguuuuucugguuccuugu

SEQ ID NO: 701 - RNA, 19 nt, artificial
  Chemically synthesized
cucaucucacaaaauugca

SEQ ID NO: 702 - RNA, 19 nt, artificial
  Chemically synthesized
cauuuuucagaacuaucca

SEQ ID NO: 703 - RNA, 19 nt, artificial
  Chemically synthesized
gagcaacuugacucauuuc

SEQ ID NO: 704 - RNA, 19 nt, artificial
  Chemically synthesized
ggagaccuauagugacucc

SEQ ID NO: 705 - RNA, 19 nt, artificial
  Chemically synthesized
ucccauauuuaagaccagu

SEQ ID NO: 706 - RNA, 19 nt, artificial
  Chemically synthesized
ggaugccuggcccucucua

SEQ ID NO: 707 - RNA, 19 nt, artificial
  Chemically synthesized
gcagaacccauggauauag

SEQ ID NO: 708 - RNA, 19 nt, artificial
  Chemically synthesized
cucugugcagcugaucuca

SEQ ID NO: 709 - RNA, 19 nt, artificial
  Chemically synthesized
auaucauugacuccauuga

SEQ ID NO: 710 - RNA, 19 nt, artificial
  Chemically synthesized
uuucauucuaugccugaaa

SEQ ID NO: 711 - RNA, 19 nt, artificial
  Chemically synthesized
auucccaagacacuggaaa

SEQ ID NO: 712 - RNA, 19 nt, artificial
  Chemically synthesized
auccaaaggagaccuauag

SEQ ID NO: 713 - RNA, 19 nt, artificial
  Chemically synthesized
agcaacuggcuuaguucau

SEQ ID NO: 714 - RNA, 19 nt, artificial
  Chemically synthesized
cuacuggguggagaaccuu

SEQ ID NO: 715 - RNA, 19 nt, artificial
  Chemically synthesized
cuuuggaagcugguggcaa

SEQ ID NO: 716 - RNA, 19 nt, artificial
  Chemically synthesized
uucauaugaagcagcauau

SEQ ID NO: 717 - RNA, 19 nt, artificial
  Chemically synthesized
caaugaugcugccauucuc

SEQ ID NO: 718 - RNA, 19 nt, artificial
  Chemically synthesized
guagcaacuggcuuaguuc

SEQ ID NO: 719 - RNA, 19 nt, artificial
  Chemically synthesized
cuauccacuggugaaacaa

SEQ ID NO: 720 - RNA, 19 nt, artificial
  Chemically synthesized
cagugaccuacagaggugu

SEQ ID NO: 721 - RNA, 19 nt, artificial
  Chemically synthesized
gcaauaacuucauuugcuc

SEQ ID NO: 722 - RNA, 19 nt, artificial
  Chemically synthesized
uggcaucauuggaaaaaac

SEQ ID NO: 723 - RNA, 19 nt, artificial
  Chemically synthesized
aaaccuuggaauaugcagc

SEQ ID NO: 724 - RNA, 19 nt, artificial
  Chemically synthesized
uugguguucauuaucuucc

SEQ ID NO: 725 - RNA, 19 nt, artificial
  Chemically synthesized
uuaaaguuuguagagaggg

SEQ ID NO: 726 - RNA, 19 nt, artificial
  Chemically synthesized
uuuuuucucaaugggcucc

SEQ ID NO: 727 - RNA, 19 nt, artificial
  Chemically synthesized
aaacacugggagaacuccg

SEQ ID NO: 728 - RNA, 19 nt, artificial
  Chemically synthesized
uuaccaacuccauuaaggg

SEQ ID NO: 729 - RNA, 19 nt, artificial
  Chemically synthesized
uuaugaucaugguuaucuc

SEQ ID NO: 730 - RNA, 19 nt, artificial
  Chemically synthesized
uugccaggaaugaaguccc

SEQ ID NO: 731 - RNA, 19 nt, artificial
  Chemically synthesized
ucagauaucaguaauagac

SEQ ID NO: 732 - RNA, 19 nt, artificial
  Chemically synthesized
uugacuucaaacuuuuugg

SEQ ID NO: 733 - RNA, 19 nt, artificial
  Chemically synthesized
aaaugagucaaguugcucc

SEQ ID NO: 734 - RNA, 19 nt, artificial
  Chemically synthesized
uuuucauauaccacaggcc

SEQ ID NO: 735 - RNA, 19 nt, artificial
  Chemically synthesized
aaauccuucccgcugagcc

SEQ ID NO: 736 - RNA, 19 nt, artificial
  Chemically synthesized
aacaucuacaaaaaucucc

SEQ ID NO: 737 - RNA, 19 nt, artificial
  Chemically synthesized
ugaaaguaaacaaggaacc

SEQ ID NO: 738 - RNA, 19 nt, artificial
  Chemically synthesized
aaauacuuugccuuguugc

SEQ ID NO: 739 - RNA, 19 nt, artificial
  Chemically synthesized
ucucuuagcaggaagaaag

SEQ ID NO: 740 - RNA, 19 nt, artificial
  Chemically synthesized
aacuagacaaagacugguc

SEQ ID NO: 741 - RNA, 19 nt, artificial
  Chemically synthesized
uuuccuaaugaacuaagcc

SEQ ID NO: 742 - RNA, 19 nt, artificial
  Chemically synthesized
uaaaguuuguagagagggc

SEQ ID NO: 743 - RNA, 19 nt, artificial
  Chemically synthesized
aauagacuuaugaucaugg

SEQ ID NO: 744 - RNA, 19 nt, artificial
  Chemically synthesized
uguugugaaaguaaacaag

SEQ ID NO: 745 - RNA, 19 nt, artificial
  Chemically synthesized
uuguccagugcuucaaccc

SEQ ID NO: 746 - RNA, 19 nt, artificial
  Chemically synthesized
auaaagaucccaacuagac

SEQ ID NO: 747 - RNA, 19 nt, artificial
  Chemically synthesized
acuagugacauaaagaucc

SEQ ID NO: 748 - RNA, 19 nt, artificial
  Chemically synthesized
agucucuccgguuuuuucc

SEQ ID NO: 749 - RNA, 19 nt, artificial
  Chemically synthesized
uuaauaggaaauacacagc

SEQ ID NO: 750 - RNA, 19 nt, artificial
  Chemically synthesized
caaauuuucacugagaucc

SEQ ID NO: 751 - RNA, 19 nt, artificial
  Chemically synthesized
uuagcaggaagaaagaaug

SEQ ID NO: 752 - RNA, 19 nt, artificial
  Chemically synthesized
auaggucuccuuuggaucc

SEQ ID NO: 753 - RNA, 19 nt, artificial
  Chemically synthesized
uuuuguaaggauuucccag

SEQ ID NO: 754 - RNA, 19 nt, artificial
  Chemically synthesized
uuguucucaucaaaaagac

SEQ ID NO: 755 - RNA, 19 nt, artificial
  Chemically synthesized
ucaaugaauuuguuucacc

SEQ ID NO: 756 - RNA, 19 nt, artificial
  Chemically synthesized
ucagaaagcacaaagacag

SEQ ID NO: 757 - RNA, 19 nt, artificial
  Chemically synthesized
uucaccaguggauaguucu

SEQ ID NO: 758 - RNA, 19 nt, artificial
  Chemically synthesized
uucugaauugacuucaaac

SEQ ID NO: 759 - RNA, 19 nt, artificial
  Chemically synthesized
uuuuucucaaugggcucca

SEQ ID NO: 760 - RNA, 19 nt, artificial
  Chemically synthesized
aauagcaacaaguuuuggg

SEQ ID NO: 761 - RNA, 19 nt, artificial
  Chemically synthesized
uaaagaucccaacuagaca

SEQ ID NO: 762 - RNA, 19 nt, artificial
  Chemically synthesized
uccaguucauacuugcacc

SEQ ID NO: 763 - RNA, 19 nt, artificial
  Chemically synthesized
uuuuucuaggaauagcaac

SEQ ID NO: 764 - RNA, 19 nt, artificial
  Chemically synthesized
uuacccaaaauccuucccg

SEQ ID NO: 765 - RNA, 19 nt, artificial
  Chemically synthesized
aaccuuggaauaugcagcc

SEQ ID NO: 766 - RNA, 19 nt, artificial
  Chemically synthesized
uuagucaaguuuuucagag

SEQ ID NO: 767 - RNA, 19 nt, artificial
  Chemically synthesized
ucagagugagcaaagucuc

SEQ ID NO: 768 - RNA, 19 nt, artificial
  Chemically synthesized
uucacuuggucacuaagag

SEQ ID NO: 769 - RNA, 19 nt, artificial
  Chemically synthesized
uggaccauaagguucucca

SEQ ID NO: 770 - RNA, 19 nt, artificial
  Chemically synthesized
augauauugucaaugaucc

SEQ ID NO: 771 - RNA, 19 nt, artificial
  Chemically synthesized
uugcuaauguaggugaucc

SEQ ID NO: 772 - RNA, 19 nt, artificial
  Chemically synthesized
auugaaguucuccagcucc

SEQ ID NO: 773 - RNA, 19 nt, artificial
  Chemically synthesized
uuuacagcuucugugagcc

SEQ ID NO: 774 - RNA, 19 nt, artificial
  Chemically synthesized
auauugucaaugauccacu

SEQ ID NO: 775 - RNA, 19 nt, artificial
  Chemically synthesized
aaucaaucaagacuuuggc

SEQ ID NO: 776 - RNA, 19 nt, artificial
  Chemically synthesized
aauggcagcaucauuguuc

SEQ ID NO: 777 - RNA, 19 nt, artificial
  Chemically synthesized
uucagagugagcaaagucu

SEQ ID NO: 778 - RNA, 19 nt, artificial
  Chemically synthesized
aucccaacuagacaaagac

SEQ ID NO: 779 - RNA, 19 nt, artificial
  Chemically synthesized
ucuaauucuaacaauccag

SEQ ID NO: 780 - RNA, 19 nt, artificial
  Chemically synthesized
acugauaucaauguuaguc

SEQ ID NO: 781 - RNA, 19 nt, artificial
  Chemically synthesized
uuuggauccugcuugcaac

SEQ ID NO: 782 - RNA, 19 nt, artificial
  Chemically synthesized
accauaagguucuccaccc

SEQ ID NO: 783 - RNA, 19 nt, artificial
  Chemically synthesized
aucugguagagucaucaac

SEQ ID NO: 784 - RNA, 19 nt, artificial
  Chemically synthesized
augaagucaaccaacugug

SEQ ID NO: 785 - RNA, 19 nt, artificial
  Chemically synthesized
uuggaugucagcaccagag

SEQ ID NO: 786 - RNA, 19 nt, artificial
  Chemically synthesized
uaaaguucuuugaguugcg

SEQ ID NO: 787 - RNA, 19 nt, artificial
  Chemically synthesized
aguuuuaguaagcaagucc

SEQ ID NO: 788 - RNA, 19 nt, artificial
  Chemically synthesized
uauccauggguucugcauc

SEQ ID NO: 789 - RNA, 19 nt, artificial
  Chemically synthesized
auuuucacugagauccaag

SEQ ID NO: 790 - RNA, 19 nt, artificial
  Chemically synthesized
uuuucuaggaauagcaaca

SEQ ID NO: 791 - RNA, 19 nt, artificial
  Chemically synthesized
aaaguauguggcauugucc

SEQ ID NO: 792 - RNA, 19 nt, artificial
  Chemically synthesized
aucaguaucucgcaguucc

SEQ ID NO: 793 - RNA, 19 nt, artificial
  Chemically synthesized
ugcaacaccaaacacuggg

SEQ ID NO: 794 - RNA, 19 nt, artificial
  Chemically synthesized
uaaugaacuaagccaguug

SEQ ID NO: 795 - RNA, 19 nt, artificial
  Chemically synthesized
aaauaugggaaccuaggac

SEQ ID NO: 796 - RNA, 19 nt, artificial
  Chemically synthesized
uuaccuggaucuauaacuc

SEQ ID NO: 797 - RNA, 19 nt, artificial
  Chemically synthesized
aaguucuuugaguugcggc

SEQ ID NO: 798 - RNA, 19 nt, artificial
  Chemically synthesized
ucugguagagucaucaacu

SEQ ID NO: 799 - RNA, 19 nt, artificial
  Chemically synthesized
aaauguucaagacugccca

SEQ ID NO: 800 - RNA, 19 nt, artificial
  Chemically synthesized
uuacacuguguauucgugu

SEQ ID NO: 801 - RNA, 19 nt, artificial
  Chemically synthesized
aaaguuuucagaaagcaca

SEQ ID NO: 802 - RNA, 19 nt, artificial
  Chemically synthesized
uacuuugccuuguugcucu

SEQ ID NO: 803 - RNA, 19 nt, artificial
  Chemically synthesized
ucacuguugcuaauguagg

SEQ ID NO: 804 - RNA, 19 nt, artificial
  Chemically synthesized
auacacagcacuuuuuucu

SEQ ID NO: 805 - RNA, 19 nt, artificial
  Chemically synthesized
uguccugugacauuccgac

SEQ ID NO: 806 - RNA, 19 nt, artificial
  Chemically synthesized
auuguguuaauuccauugg

SEQ ID NO: 807 - RNA, 19 nt, artificial
  Chemically synthesized
uuccaaagucuucagugug

SEQ ID NO: 808 - RNA, 19 nt, artificial
  Chemically synthesized
uaugcugcuucauaugaag

SEQ ID NO: 809 - RNA, 19 nt, artificial
  Chemically synthesized
agaacuccgagcagucacc

SEQ ID NO: 810 - RNA, 19 nt, artificial
  Chemically synthesized
uuuacuguuuucuacugug

SEQ ID NO: 811 - RNA, 19 nt, artificial
  Chemically synthesized
aaaguaaacaaggaaccag

SEQ ID NO: 812 - RNA, 19 nt, artificial
  Chemically synthesized
uuuucucaaugggcuccag

SEQ ID NO: 813 - RNA, 19 nt, artificial
  Chemically synthesized
ugaagacacaacuugaagg

SEQ ID NO: 814 - RNA, 19 nt, artificial
  Chemically synthesized
aaacuuuuuggcucauagc

SEQ ID NO: 815 - RNA, 19 nt, artificial
  Chemically synthesized
aagaaugacacagucauug

SEQ ID NO: 816 - RNA, 19 nt, artificial
  Chemically synthesized
aauggcuuuuuucucaaug

SEQ ID NO: 817 - RNA, 19 nt, artificial
  Chemically synthesized
aaugcagccuguuacacug

SEQ ID NO: 818 - RNA, 19 nt, artificial
  Chemically synthesized
uuucagaaagcacaaagac

SEQ ID NO: 819 - RNA, 19 nt, artificial
  Chemically synthesized
auaaaguucuuugaguugc

SEQ ID NO: 820 - RNA, 19 nt, artificial
  Chemically synthesized
aagacuggucuuaaauaug

SEQ ID NO: 821 - RNA, 19 nt, artificial
  Chemically synthesized
agcaucaaucucaaguucc

SEQ ID NO: 822 - RNA, 19 nt, artificial
  Chemically synthesized
uguuagucaaguuuuucag

SEQ ID NO: 823 - RNA, 19 nt, artificial
  Chemically synthesized
auuguccagugcuucaacc

SEQ ID NO: 824 - RNA, 19 nt, artificial
  Chemically synthesized
aauguuaaagaagaaaggg

SEQ ID NO: 825 - RNA, 19 nt, artificial
  Chemically synthesized
uucccuuggauaccaaggg

SEQ ID NO: 826 - RNA, 19 nt, artificial
  Chemically synthesized
ugaagcaucaaucucaagu

SEQ ID NO: 827 - RNA, 19 nt, artificial
  Chemically synthesized
uuuguggcucuuuucaaug

SEQ ID NO: 828 - RNA, 19 nt, artificial
  Chemically synthesized
uuuucacugagauccaagu

SEQ ID NO: 829 - RNA, 19 nt, artificial
  Chemically synthesized
uucauaugaaggaucagau

SEQ ID NO: 830 - RNA, 19 nt, artificial
  Chemically synthesized
auacuuugccuuguugcuc

SEQ ID NO: 831 - RNA, 19 nt, artificial
  Chemically synthesized
aaaugaaguuauugccacc

SEQ ID NO: 832 - RNA, 19 nt, artificial
  Chemically synthesized
uguaguuuuaguaagcaag

SEQ ID NO: 833 - RNA, 19 nt, artificial
  Chemically synthesized
aauaugggaaccuaggacu

SEQ ID NO: 834 - RNA, 19 nt, artificial
  Chemically synthesized
cuugccaggaaugaagucc

SEQ ID NO: 835 - RNA, 19 nt, artificial
  Chemically synthesized
uacagauuacaguuggccc

SEQ ID NO: 836 - RNA, 19 nt, artificial
  Chemically synthesized
auauuucaucuuuucuggc

SEQ ID NO: 837 - RNA, 19 nt, artificial
  Chemically synthesized
agagugagcaaagucucuc

SEQ ID NO: 838 - RNA, 19 nt, artificial
  Chemically synthesized
uaauaggaaauacacagca

SEQ ID NO: 839 - RNA, 19 nt, artificial
  Chemically synthesized
ugacuucaaacuuuuuggc

SEQ ID NO: 840 - RNA, 19 nt, artificial
  Chemically synthesized
ucauacuugcaccacucac

SEQ ID NO: 841 - RNA, 19 nt, artificial
  Chemically synthesized
ucagugugugaaaugaguc

SEQ ID NO: 842 - RNA, 19 nt, artificial
  Chemically synthesized
ugucauuaucagaugcucu

SEQ ID NO: 843 - RNA, 19 nt, artificial
  Chemically synthesized
aacaaaugcaucauagcag

SEQ ID NO: 844 - RNA, 19 nt, artificial
  Chemically synthesized
aaacgguggcacaggaccc

SEQ ID NO: 845 - RNA, 19 nt, artificial
  Chemically synthesized
aaguccaguucauacuugc

SEQ ID NO: 846 - RNA, 19 nt, artificial
  Chemically synthesized
uucauuaucuuccgcagcu

SEQ ID NO: 847 - RNA, 19 nt, artificial
  Chemically synthesized
uuaacucuuucuguaagug

SEQ ID NO: 848 - RNA, 19 nt, artificial
  Chemically synthesized
aagucuaaauguucaagac

SEQ ID NO: 849 - RNA, 19 nt, artificial
  Chemically synthesized
auggcuuuuuucucaaugg

SEQ ID NO: 850 - RNA, 19 nt, artificial
  Chemically synthesized
aacucugucauuaucagau

SEQ ID NO: 851 - RNA, 19 nt, artificial
  Chemically synthesized
acuagacaaagacuggucu

SEQ ID NO: 852 - RNA, 19 nt, artificial
  Chemically synthesized
agagccuggagguucacac

SEQ ID NO: 853 - RNA, 19 nt, artificial
  Chemically synthesized
uuccuuuuggccuggagcc

SEQ ID NO: 854 - RNA, 19 nt, artificial
  Chemically synthesized
agugucuugggaaugcagc

SEQ ID NO: 855 - RNA, 19 nt, artificial
  Chemically synthesized
aaggagaggaauucacagg

SEQ ID NO: 856 - RNA, 19 nt, artificial
  Chemically synthesized
aaagacaguuuuguggcuc

SEQ ID NO: 857 - RNA, 19 nt, artificial
  Chemically synthesized
aaucucaaguuccucaagg

SEQ ID NO: 858 - RNA, 19 nt, artificial
  Chemically synthesized
uucugaaaaauggaaagug

SEQ ID NO: 859 - RNA, 19 nt, artificial
  Chemically synthesized
uuggccuggagccaggccc

SEQ ID NO: 860 - RNA, 19 nt, artificial
  Chemically synthesized
uuucagagugagcaaaguc

SEQ ID NO: 861 - RNA, 19 nt, artificial
  Chemically synthesized
acucuaauucuaacaaucc

SEQ ID NO: 862 - RNA, 19 nt, artificial
  Chemically synthesized
agugcuucaacccacaacu

SEQ ID NO: 863 - RNA, 19 nt, artificial
  Chemically synthesized
uaauuccauuggaugucag

SEQ ID NO: 864 - RNA, 19 nt, artificial
  Chemically synthesized
agcaaaugaaguuauugcc

SEQ ID NO: 865 - RNA, 19 nt, artificial
  Chemically synthesized
aaggguacagucaucaaac

SEQ ID NO: 866 - RNA, 19 nt, artificial
  Chemically synthesized
uuuuacagcuucugugagc

SEQ ID NO: 867 - RNA, 19 nt, artificial
  Chemically synthesized
aagucucuccgguuuuuuc

SEQ ID NO: 868 - RNA, 19 nt, artificial
  Chemically synthesized
aacuagugacauaaagauc

SEQ ID NO: 869 - RNA, 19 nt, artificial
  Chemically synthesized
auuuucauauaccacaggc

SEQ ID NO: 870 - RNA, 19 nt, artificial
  Chemically synthesized
ugucaaugauccacuugcc

SEQ ID NO: 871 - RNA, 19 nt, artificial
  Chemically synthesized
uguaagaaacaaaugcauc

SEQ ID NO: 872 - RNA, 19 nt, artificial
  Chemically synthesized
aauacuuugccuuguugcu

SEQ ID NO: 873 - RNA, 19 nt, artificial
  Chemically synthesized
aaaaccuuggaauaugcag

SEQ ID NO: 874 - RNA, 19 nt, artificial
  Chemically synthesized
uguccaaaucaguaucucg

SEQ ID NO: 875 - RNA, 19 nt, artificial
  Chemically synthesized
uauauccauggguucugca

SEQ ID NO: 876 - RNA, 19 nt, artificial
  Chemically synthesized
aauauaaagugcucagauc

SEQ ID NO: 877 - RNA, 19 nt, artificial
  Chemically synthesized
caguaauagacuuaugauc

SEQ ID NO: 878 - RNA, 19 nt, artificial
  Chemically synthesized
uugauauccacgaggaucc

SEQ ID NO: 879 - RNA, 19 nt, artificial
  Chemically synthesized
uuucucaaugggcuccaga

SEQ ID NO: 880 - RNA, 19 nt, artificial
  Chemically synthesized
auaccaagggacuauauuc

SEQ ID NO: 881 - RNA, 19 nt, artificial
  Chemically synthesized
uugccuuguugcucuugag

SEQ ID NO: 882 - RNA, 19 nt, artificial
  Chemically synthesized
uuccgcagcuugcagaagc

SEQ ID NO: 883 - RNA, 19 nt, artificial
  Chemically synthesized
aaccaucaaauuuucacug

SEQ ID NO: 884 - RNA, 19 nt, artificial
  Chemically synthesized
uaaccugaaacaaacuuuc

SEQ ID NO: 885 - RNA, 19 nt, artificial
  Chemically synthesized
auuaaaguuuguagagagg

SEQ ID NO: 886 - RNA, 19 nt, artificial
  Chemically synthesized
uaugaucaugguuaucuca

SEQ ID NO: 887 - RNA, 19 nt, artificial
  Chemically synthesized
auuggaggauucuuccuug

SEQ ID NO: 888 - RNA, 19 nt, artificial
  Chemically synthesized
uugaaagcagugaaagagc

SEQ ID NO: 889 - RNA, 19 nt, artificial
  Chemically synthesized
uccuaaugaacuaagccag

SEQ ID NO: 890 - RNA, 19 nt, artificial
  Chemically synthesized
aaugaacuaagccaguugc

SEQ ID NO: 891 - RNA, 19 nt, artificial
  Chemically synthesized
aacacugggagaacuccga

SEQ ID NO: 892 - RNA, 19 nt, artificial
  Chemically synthesized
uuccugggcuuccuuuugg

SEQ ID NO: 893 - RNA, 19 nt, artificial
  Chemically synthesized
acugggagaacuccgagca

SEQ ID NO: 894 - RNA, 19 nt, artificial
  Chemically synthesized
agagaaugccuuuuguggc

SEQ ID NO: 895 - RNA, 19 nt, artificial
  Chemically synthesized
ucuaaaauuaccaacucca

SEQ ID NO: 896 - RNA, 19 nt, artificial
  Chemically synthesized
ugaaucuuagugaaggugu

SEQ ID NO: 897 - RNA, 19 nt, artificial
  Chemically synthesized
agugagcaaagucucuccg

SEQ ID NO: 898 - RNA, 19 nt, artificial
  Chemically synthesized
augaauuuugauauccacg

SEQ ID NO: 899 - RNA, 19 nt, artificial
  Chemically synthesized
uguuacacuguguauucgu

SEQ ID NO: 900 - RNA, 19 nt, artificial
  Chemically synthesized
ucuaggaauagcaacaagu

SEQ ID NO: 901 - RNA, 19 nt, artificial
  Chemically synthesized
aacuuuuuggcucauagcu

SEQ ID NO: 902 - RNA, 19 nt, artificial
  Chemically synthesized
auacuugcaccacucacuc

SEQ ID NO: 903 - RNA, 19 nt, artificial
  Chemically synthesized
uucauaaccugaaacaaac

SEQ ID NO: 904 - RNA, 19 nt, artificial
  Chemically synthesized
uuacagcuucugugagccc

SEQ ID NO: 905 - RNA, 19 nt, artificial
  Chemically synthesized
aguuauugcauuccuacug

SEQ ID NO: 906 - RNA, 19 nt, artificial
  Chemically synthesized
acuguaagaaacaaaugca

SEQ ID NO: 907 - RNA, 19 nt, artificial
  Chemically synthesized
uuugaaucuuagugaaggu

SEQ ID NO: 908 - RNA, 19 nt, artificial
  Chemically synthesized
agguucuccacccaguagg

SEQ ID NO: 909 - RNA, 19 nt, artificial
  Chemically synthesized
auuaucuuccgcagcuugc

SEQ ID NO: 910 - RNA, 19 nt, artificial
  Chemically synthesized
ugaugccaaaugauuuugc

SEQ ID NO: 911 - RNA, 19 nt, artificial
  Chemically synthesized
uuuccugggcuuccuuuug

SEQ ID NO: 912 - RNA, 19 nt, artificial
  Chemically synthesized
uuggaggauucuuccuugg

SEQ ID NO: 913 - RNA, 19 nt, artificial
  Chemically synthesized
uuucaucggugauuuucac

SEQ ID NO: 914 - RNA, 19 nt, artificial
  Chemically synthesized
aauuccauuggaugucagc

SEQ ID NO: 915 - RNA, 19 nt, artificial
  Chemically synthesized
uucccgcugagccucgucc

SEQ ID NO: 916 - RNA, 19 nt, artificial
  Chemically synthesized
uguucucaucaaaaagacg

SEQ ID NO: 917 - RNA, 19 nt, artificial
  Chemically synthesized
uuaucuuccgcagcuugca

SEQ ID NO: 918 - RNA, 19 nt, artificial
  Chemically synthesized
ucaaugauccacuugccag

SEQ ID NO: 919 - RNA, 19 nt, artificial
  Chemically synthesized
ucauagcagauguuccugc

SEQ ID NO: 920 - RNA, 19 nt, artificial
  Chemically synthesized
uucaaguauucuucaacca

SEQ ID NO: 921 - RNA, 19 nt, artificial
  Chemically synthesized
uuugcaauuuugugagaug

SEQ ID NO: 922 - RNA, 19 nt, artificial
  Chemically synthesized
ucugaauugacuucaaacu

SEQ ID NO: 923 - RNA, 19 nt, artificial
  Chemically synthesized
aaaugcaucauagcagaug

SEQ ID NO: 924 - RNA, 19 nt, artificial
  Chemically synthesized
uucuuccuuggagaggcug

SEQ ID NO: 925 - RNA, 19 nt, artificial
  Chemically synthesized
uuagugaagguguccauau

SEQ ID NO: 926 - RNA, 19 nt, artificial
  Chemically synthesized
uuuacccaaaauccuuccc

SEQ ID NO: 927 - RNA, 19 nt, artificial
  Chemically synthesized
uuucuggccacugacaagu

SEQ ID NO: 928 - RNA, 19 nt, artificial
  Chemically synthesized
ugucuugggaaugcagccu

SEQ ID NO: 929 - RNA, 19 nt, artificial
  Chemically synthesized
guucucaucaaaaagacgg

SEQ ID NO: 930 - RNA, 19 nt, artificial
  Chemically synthesized
uuuuuggcucauagcucug

SEQ ID NO: 931 - RNA, 19 nt, artificial
  Chemically synthesized
uggucuuaaauaugggaac

SEQ ID NO: 932 - RNA, 19 nt, artificial
  Chemically synthesized
ugaaguuauugccaccagc

SEQ ID NO: 933 - RNA, 19 nt, artificial
  Chemically synthesized
uucagaaagcacaaagaca

SEQ ID NO: 934 - RNA, 19 nt, artificial
  Chemically synthesized
acaacuaccaguugaaagc

SEQ ID NO: 935 - RNA, 19 nt, artificial
  Chemically synthesized
uacccaaaauccuucccgc

SEQ ID NO: 936 - RNA, 19 nt, artificial
  Chemically synthesized
uaagccaguugcuacagau

SEQ ID NO: 937 - RNA, 19 nt, artificial
  Chemically synthesized
aaauaugcugcuucauaug

SEQ ID NO: 938 - RNA, 19 nt, artificial
  Chemically synthesized
acuucaaacuuuuuggcuc

SEQ ID NO: 939 - RNA, 19 nt, artificial
  Chemically synthesized
uguucauuaucuuccgcag

SEQ ID NO: 940 - RNA, 19 nt, artificial
  Chemically synthesized
agacuggucuuaaauaugg

SEQ ID NO: 941 - RNA, 19 nt, artificial
  Chemically synthesized
ucaaauuuucacugagauc

SEQ ID NO: 942 - RNA, 19 nt, artificial
  Chemically synthesized
acaggcugaauuuuucaag

SEQ ID NO: 943 - RNA, 19 nt, artificial
  Chemically synthesized
uaaaauuuccagugucuug

SEQ ID NO: 944 - RNA, 19 nt, artificial
  Chemically synthesized
gauucuuccuuggagaggc

SEQ ID NO: 945 - RNA, 19 nt, artificial
  Chemically synthesized
uguuuauaaaacagcaccc

SEQ ID NO: 946 - RNA, 19 nt, artificial
  Chemically synthesized
uagacaaagacuggucuua

SEQ ID NO: 947 - RNA, 19 nt, artificial
  Chemically synthesized
ugagccucguccaugggcc

SEQ ID NO: 948 - RNA, 19 nt, artificial
  Chemically synthesized
aucuacaaaaaucuccagc

SEQ ID NO: 949 - RNA, 19 nt, artificial
  Chemically synthesized
auaggaaauacacagcacu

SEQ ID NO: 950 - RNA, 19 nt, artificial
  Chemically synthesized
gagaggcugaugaugaccc

SEQ ID NO: 951 - RNA, 19 nt, artificial
  Chemically synthesized
uuccuaaugaacuaagcca

SEQ ID NO: 952 - RNA, 19 nt, artificial
  Chemically synthesized
auuaaggguacagucauca

SEQ ID NO: 953 - RNA, 19 nt, artificial
  Chemically synthesized
auuugcuggccaaucaauc

SEQ ID NO: 954 - RNA, 19 nt, artificial
  Chemically synthesized
auucccuuggauaccaagg

SEQ ID NO: 955 - RNA, 19 nt, artificial
  Chemically synthesized
cuguuuucuacugugauuc

SEQ ID NO: 956 - RNA, 19 nt, artificial
  Chemically synthesized
guugugaaaguaaacaagg

SEQ ID NO: 957 - RNA, 19 nt, artificial
  Chemically synthesized
cacuguaagaaacaaaugc

SEQ ID NO: 958 - RNA, 19 nt, artificial
  Chemically synthesized
ucacuguaagaaacaaaug

SEQ ID NO: 959 - RNA, 19 nt, artificial
  Chemically synthesized
aaagaucccaacuagacaa

SEQ ID NO: 960 - RNA, 19 nt, artificial
  Chemically synthesized
uaggucuccuuuggauccu

SEQ ID NO: 961 - RNA, 19 nt, artificial
  Chemically synthesized
ugacgguacauccacguag

SEQ ID NO: 962 - RNA, 19 nt, artificial
  Chemically synthesized
uuuuucagagugagcaaag

SEQ ID NO: 963 - RNA, 19 nt, artificial
  Chemically synthesized
aaacguaguuauugcauuc

SEQ ID NO: 964 - RNA, 19 nt, artificial
  Chemically synthesized
uggcuuuuuucucaauggg

SEQ ID NO: 965 - RNA, 19 nt, artificial
  Chemically synthesized
ugacuuacauucugaauug

SEQ ID NO: 966 - RNA, 19 nt, artificial
  Chemically synthesized
uuuucagaaagcacaaaga

SEQ ID NO: 967 - RNA, 19 nt, artificial
  Chemically synthesized
agacagagaagccugauug

SEQ ID NO: 968 - RNA, 19 nt, artificial
  Chemically synthesized
acugugauucuuuuaacuc

SEQ ID NO: 969 - RNA, 19 nt, artificial
  Chemically synthesized
acaaagacaguuuuguggc

SEQ ID NO: 970 - RNA, 19 nt, artificial
  Chemically synthesized
uccucuauuguguuaauuc

SEQ ID NO: 971 - RNA, 19 nt, artificial
  Chemically synthesized
uucuccagcuccuggacca

SEQ ID NO: 972 - RNA, 19 nt, artificial
  Chemically synthesized
ugaaggagaggaauucaca

SEQ ID NO: 973 - RNA, 19 nt, artificial
  Chemically synthesized
uccauuggaugucagcacc

SEQ ID NO: 974 - RNA, 19 nt, artificial
  Chemically synthesized
aacuccauuaaggguacag

SEQ ID NO: 975 - RNA, 19 nt, artificial
  Chemically synthesized
ucuguagaucugaagcauc

SEQ ID NO: 976 - RNA, 19 nt, artificial
  Chemically synthesized
uucagugugugaaaugagu

SEQ ID NO: 977 - RNA, 19 nt, artificial
  Chemically synthesized
uuggcucauagcucuguag

SEQ ID NO: 978 - RNA, 19 nt, artificial
  Chemically synthesized
uacacuguguauucgugug

SEQ ID NO: 979 - RNA, 19 nt, artificial
  Chemically synthesized
uucugcauccaugaaguca

SEQ ID NO: 980 - RNA, 19 nt, artificial
  Chemically synthesized
uuucccaguaaguuuaaga

SEQ ID NO: 981 - RNA, 19 nt, artificial
  Chemically synthesized
uaagguucuccacccagua

SEQ ID NO: 982 - RNA, 19 nt, artificial
  Chemically synthesized
uuaauuccauuggauguca

SEQ ID NO: 983 - RNA, 19 nt, artificial
  Chemically synthesized
caaacacugggagaacucc

SEQ ID NO: 984 - RNA, 19 nt, artificial
  Chemically synthesized
auauccacgaggauccugc

SEQ ID NO: 985 - RNA, 19 nt, artificial
  Chemically synthesized
uuuuguggcucuuuucaau

SEQ ID NO: 986 - RNA, 19 nt, artificial
  Chemically synthesized
aauacuaguaacaugggua

SEQ ID NO: 987 - RNA, 19 nt, artificial
  Chemically synthesized
cuuuuuucuaggaauagca

SEQ ID NO: 988 - RNA, 19 nt, artificial
  Chemically synthesized
auccauggguucugcaucc

SEQ ID NO: 989 - RNA, 19 nt, artificial
  Chemically synthesized
aucuuaaguucauuugugc

SEQ ID NO: 990 - RNA, 19 nt, artificial
  Chemically synthesized
uccugggcuuccuuuuggc

SEQ ID NO: 991 - RNA, 19 nt, artificial
  Chemically synthesized
uucacaggagcaaaugaag

SEQ ID NO: 992 - RNA, 19 nt, artificial
  Chemically synthesized
auuuacccaaaauccuucc

SEQ ID NO: 993 - RNA, 19 nt, artificial
  Chemically synthesized
aaacaaacuuucaucggug

SEQ ID NO: 994 - RNA, 19 nt, artificial
  Chemically synthesized
uucucaaugggcuccagaa

SEQ ID NO: 995 - RNA, 19 nt, artificial
  Chemically synthesized
ucccacucucaggauuugc

SEQ ID NO: 996 - RNA, 19 nt, artificial
  Chemically synthesized
uagacuuaugaucaugguu

SEQ ID NO: 997 - RNA, 19 nt, artificial
  Chemically synthesized
auguucaagacugcccagg

SEQ ID NO: 998 - RNA, 19 nt, artificial
  Chemically synthesized
ucauuuucauauaccacag

SEQ ID NO: 999 - RNA, 19 nt, artificial
  Chemically synthesized
ugagcaaagucucuccggu

SEQ ID NO: 1000 - RNA, 19 nt, artificial
  Chemically synthesized
ugcccuugcagauaccauu

SEQ ID NO: 1001 - RNA, 19 nt, artificial
  Chemically synthesized
aaaguucuuugaguugcgg

SEQ ID NO: 1002 - RNA, 19 nt, artificial
  Chemically synthesized
uugaguugcggcaaauuca

SEQ ID NO: 1003 - RNA, 19 nt, artificial
  Chemically synthesized
uugaaguucuccagcuccu

SEQ ID NO: 1004 - RNA, 19 nt, artificial
  Chemically synthesized
uuuuuacagcuucugugag

SEQ ID NO: 1005 - RNA, 19 nt, artificial
  Chemically synthesized
auaagguucuccacccagu

SEQ ID NO: 1006 - RNA, 19 nt, artificial
  Chemically synthesized
acagagaaugccuuuugug

SEQ ID NO: 1007 - RNA, 19 nt, artificial
  Chemically synthesized
uuggagaggcugaugauga

SEQ ID NO: 1008 - RNA, 19 nt, artificial
  Chemically synthesized
ugcuccuuagaaaacguag

SEQ ID NO: 1009 - RNA, 19 nt, artificial
  Chemically synthesized
ucuauauccauggguucug

SEQ ID NO: 1010 - RNA, 19 nt, artificial
  Chemically synthesized
ugcucuaaaauuaccaacu

SEQ ID NO: 1011 - RNA, 19 nt, artificial
  Chemically synthesized
aaguauucuucaaccauca

SEQ ID NO: 1012 - RNA, 19 nt, artificial
  Chemically synthesized
aauuuugauauccacgagg

SEQ ID NO: 1013 - RNA, 19 nt, artificial
  Chemically synthesized
cauacuugcaccacucacu

SEQ ID NO: 1014 - RNA, 19 nt, artificial
  Chemically synthesized
ugaauuuguuucaccagug

SEQ ID NO: 1015 - RNA, 19 nt, artificial
  Chemically synthesized
aaguaaacaaggaaccaga

SEQ ID NO: 1016 - RNA, 19 nt, artificial
  Chemically synthesized
uucuccacccaguaggcau

SEQ ID NO: 1017 - RNA, 19 nt, artificial
  Chemically synthesized
cccaacuagacaaagacug

SEQ ID NO: 1018 - RNA, 19 nt, artificial
  Chemically synthesized
cugauuggaggauucuucc

SEQ ID NO: 1019 - RNA, 19 nt, artificial
  Chemically synthesized
aaaugacgguacauccacg

SEQ ID NO: 1020 - RNA, 19 nt, artificial
  Chemically synthesized
aaagucucuccgguuuuuu

SEQ ID NO: 1021 - RNA, 19 nt, artificial
  Chemically synthesized
uuuuuuccaaugaugccaa

SEQ ID NO: 1022 - RNA, 19 nt, artificial
  Chemically synthesized
aauggagucaaugauauug

SEQ ID NO: 1023 - RNA, 19 nt, artificial
  Chemically synthesized
uaucgcagcucucagauuu

SEQ ID NO: 1024 - RNA, 19 nt, artificial
  Chemically synthesized
ucugucauuaucagaugcu

SEQ ID NO: 1025 - RNA, 19 nt, artificial
  Chemically synthesized
uuggucacuaagagcuccu

SEQ ID NO: 1026 - RNA, 19 nt, artificial
  Chemically synthesized
agguaggacagagaaugcc

SEQ ID NO: 1027 - RNA, 19 nt, artificial
  Chemically synthesized
auaugaaggaucagaugac

SEQ ID NO: 1028 - RNA, 19 nt, artificial
  Chemically synthesized
ugcgcuuucucgcugccuc

SEQ ID NO: 1029 - RNA, 19 nt, artificial
  Chemically synthesized
ugggaaugcagccuguuac

SEQ ID NO: 1030 - RNA, 19 nt, artificial
  Chemically synthesized
uaggucacuguugcuaaug

SEQ ID NO: 1031 - RNA, 19 nt, artificial
  Chemically synthesized
acaccauccacaaaguaug

SEQ ID NO: 1032 - RNA, 19 nt, artificial
  Chemically synthesized
ugguguucauuaucuuccg

SEQ ID NO: 1033 - RNA, 19 nt, artificial
  Chemically synthesized
uugcucuugagaucagcug

SEQ ID NO: 1034 - RNA, 19 nt, artificial
  Chemically synthesized
auguuuauaaaacagcacc

SEQ ID NO: 1035 - RNA, 19 nt, artificial
  Chemically synthesized
auauaaagugcucagauca

SEQ ID NO: 1036 - RNA, 19 nt, artificial
  Chemically synthesized
uuugccuuguugcucuuga

SEQ ID NO: 1037 - RNA, 19 nt, artificial
  Chemically synthesized
aaaaagacggaaaugggag

SEQ ID NO: 1038 - RNA, 19 nt, artificial
  Chemically synthesized
cuuaugaucaugguuaucu

SEQ ID NO: 1039 - RNA, 19 nt, artificial
  Chemically synthesized
uaguuuuaguaagcaaguc

SEQ ID NO: 1040 - RNA, 19 nt, artificial
  Chemically synthesized
gaauggaguuuaaagaucc

SEQ ID NO: 1041 - RNA, 19 nt, artificial
  Chemically synthesized
aaguuuuucagagugagca

SEQ ID NO: 1042 - RNA, 19 nt, artificial
  Chemically synthesized
aucuuuucuggccacugac

SEQ ID NO: 1043 - RNA, 19 nt, artificial
  Chemically synthesized
acaucuacaaaaaucucca

SEQ ID NO: 1044 - RNA, 19 nt, artificial
  Chemically synthesized
gugucuugggaaugcagcc

SEQ ID NO: 1045 - RNA, 19 nt, artificial
  Chemically synthesized
acugagauccaaguauucu

SEQ ID NO: 1046 - RNA, 19 nt, artificial
  Chemically synthesized
ucuaaauguucaagacugc

SEQ ID NO: 1047 - RNA, 19 nt, artificial
  Chemically synthesized
aaauuuucacugagaucca

SEQ ID NO: 1048 - RNA, 19 nt, artificial
  Chemically synthesized
acaaagacuggucuuaaau

SEQ ID NO: 1049 - RNA, 19 nt, artificial
  Chemically synthesized
uuacuguuuucuacuguga

SEQ ID NO: 1050 - RNA, 19 nt, artificial
  Chemically synthesized
gaccauaagguucuccacc

SEQ ID NO: 1051 - RNA, 19 nt, artificial
  Chemically synthesized
acuguugcuaauguaggug

SEQ ID NO: 1052 - RNA, 19 nt, artificial
  Chemically synthesized
uugcagauaccauugcggu

SEQ ID NO: 1053 - RNA, 19 nt, artificial
  Chemically synthesized
cuuacauucugaauugacu

SEQ ID NO: 1054 - RNA, 19 nt, artificial
  Chemically synthesized
ugacauaaagaucccaacu

SEQ ID NO: 1055 - RNA, 19 nt, artificial
  Chemically synthesized
aaugggcuccagaagaaug

SEQ ID NO: 1056 - RNA, 19 nt, artificial
  Chemically synthesized
uucuaggaauagcaacaag

SEQ ID NO: 1057 - RNA, 19 nt, artificial
  Chemically synthesized
uugcggucacaagacagag

SEQ ID NO: 1058 - RNA, 19 nt, artificial
  Chemically synthesized
uuuuaguaagcaaguccuc

SEQ ID NO: 1059 - RNA, 19 nt, artificial
  Chemically synthesized
uguguuaauuccauuggau

SEQ ID NO: 1060 - RNA, 19 nt, artificial
  Chemically synthesized
agaaacaaaugcaucauag

SEQ ID NO: 1061 - RNA, 19 nt, artificial
  Chemically synthesized
ccacugacaaguuucaggc

SEQ ID NO: 1062 - RNA, 19 nt, artificial
  Chemically synthesized
uaucuuccgcagcuugcag

SEQ ID NO: 1063 - RNA, 19 nt, artificial
  Chemically synthesized
gauccugcaaccaauuccc

SEQ ID NO: 1064 - RNA, 19 nt, artificial
  Chemically synthesized
uaacguuuccacuuuaccu

SEQ ID NO: 1065 - RNA, 19 nt, artificial
  Chemically synthesized
aaucaguaucucgcaguuc

SEQ ID NO: 1066 - RNA, 19 nt, artificial
  Chemically synthesized
aggauaagucuaaauguuc

SEQ ID NO: 1067 - RNA, 19 nt, artificial
  Chemically synthesized
uacuguuuucuacugugau

SEQ ID NO: 1068 - RNA, 19 nt, artificial
  Chemically synthesized
uugcaacaccaaacacugg

SEQ ID NO: 1069 - RNA, 19 nt, artificial
  Chemically synthesized
guucauacuugcaccacuc

SEQ ID NO: 1070 - RNA, 19 nt, artificial
  Chemically synthesized
cuugcaacaccaaacacug

SEQ ID NO: 1071 - RNA, 19 nt, artificial
  Chemically synthesized
aauaggaaauacacagcac

SEQ ID NO: 1072 - RNA, 19 nt, artificial
  Chemically synthesized
ucaucuuuucuggccacug

SEQ ID NO: 1073 - RNA, 19 nt, artificial
  Chemically synthesized
aaguuucaggcauagaaug

SEQ ID NO: 1074 - RNA, 19 nt, artificial
  Chemically synthesized
aaagucuucagugugugaa

SEQ ID NO: 1075 - RNA, 19 nt, artificial
  Chemically synthesized
auauuucccacucucagga

SEQ ID NO: 1076 - RNA, 19 nt, artificial
  Chemically synthesized
gaaccuaggacuuuaucgc

SEQ ID NO: 1077 - RNA, 19 nt, artificial
  Chemically synthesized
uucaacccacaacuaccag

SEQ ID NO: 1078 - RNA, 19 nt, artificial
  Chemically synthesized
aaugagucaaguugcuccu

SEQ ID NO: 1079 - RNA, 19 nt, artificial
  Chemically synthesized
caaucaaucaagacuuugg

SEQ ID NO: 1080 - RNA, 19 nt, artificial
  Chemically synthesized
aauuaccaacuccauuaag

SEQ ID NO: 1081 - RNA, 19 nt, artificial
  Chemically synthesized
uuccagugucuugggaaug

SEQ ID NO: 1082 - RNA, 19 nt, artificial
  Chemically synthesized
agauccaaguauucuaaug

SEQ ID NO: 1083 - RNA, 19 nt, artificial
  Chemically synthesized
uugugaaaguaaacaagga

SEQ ID NO: 1084 - RNA, 19 nt, artificial
  Chemically synthesized
ugaagucaaccaacugugg

SEQ ID NO: 1085 - RNA, 19 nt, artificial
  Chemically synthesized
cauuccgacaccgagaggc

SEQ ID NO: 1086 - RNA, 19 nt, artificial
  Chemically synthesized
aaagaaucuuccucuauug

SEQ ID NO: 1087 - RNA, 19 nt, artificial
  Chemically synthesized
uguuggacaggucaaggcu

SEQ ID NO: 1088 - RNA, 19 nt, artificial
  Chemically synthesized
aucaaucucaaguuccuca

SEQ ID NO: 1089 - RNA, 19 nt, artificial
  Chemically synthesized
ugaaguucuccagcuccug

SEQ ID NO: 1090 - RNA, 19 nt, artificial
  Chemically synthesized
ucaaucaagacuuuggcca

SEQ ID NO: 1091 - RNA, 19 nt, artificial
  Chemically synthesized
uccucaaggaagguaaguc

SEQ ID NO: 1092 - RNA, 19 nt, artificial
  Chemically synthesized
gcuucaacccacaacuacc

SEQ ID NO: 1093 - RNA, 19 nt, artificial
  Chemically synthesized
ucuacaaaaaucuccagca

SEQ ID NO: 1094 - RNA, 19 nt, artificial
  Chemically synthesized
aguuauugccaccagcuuc

SEQ ID NO: 1095 - RNA, 19 nt, artificial
  Chemically synthesized
ucaaaaagacggaaauggg

SEQ ID NO: 1096 - RNA, 19 nt, artificial
  Chemically synthesized
auucuuccuuggagaggcu

SEQ ID NO: 1097 - RNA, 19 nt, artificial
  Chemically synthesized
uacagcuucugugagcccu

SEQ ID NO: 1098 - RNA, 19 nt, artificial
  Chemically synthesized
ucacucuucacaaaguuuu

SEQ ID NO: 1099 - RNA, 19 nt, artificial
  Chemically synthesized
aguugcuacagauuacagu

SEQ ID NO: 1100 - RNA, 19 nt, artificial
  Chemically synthesized
aucuccagcaguaaaauau

SEQ ID NO: 1101 - RNA, 19 nt, artificial
  Chemically synthesized
agaagugacagcuagguag

SEQ ID NO: 1102 - RNA, 19 nt, artificial
  Chemically synthesized
uaugaaggaucagaugacu

SEQ ID NO: 1103 - RNA, 19 nt, artificial
  Chemically synthesized
gaucagaugacuuacauuc

SEQ ID NO: 1104 - RNA, 19 nt, artificial
  Chemically synthesized
cagugaaagagcaaugggc

SEQ ID NO: 1105 - RNA, 19 nt, artificial
  Chemically synthesized
uuguguuaauuccauugga

SEQ ID NO: 1106 - RNA, 19 nt, artificial
  Chemically synthesized
ccugauuggaggauucuuc

SEQ ID NO: 1107 - RNA, 19 nt, artificial
  Chemically synthesized
uuugauauccacgaggauc

SEQ ID NO: 1108 - RNA, 19 nt, artificial
  Chemically synthesized
aaguguccaaaucaguauc

SEQ ID NO: 1109 - RNA, 19 nt, artificial
  Chemically synthesized
aucaaaaagacggaaaugg

SEQ ID NO: 1110 - RNA, 19 nt, artificial
  Chemically synthesized
gagugagcaaagucucucc

SEQ ID NO: 1111 - RNA, 19 nt, artificial
  Chemically synthesized
ucuuugaaucuuagugaag

SEQ ID NO: 1112 - RNA, 19 nt, artificial
  Chemically synthesized
ugcauccaugaagucaacc

SEQ ID NO: 1113 - RNA, 19 nt, artificial
  Chemically synthesized
aguugcggcaaauucaaag

SEQ ID NO: 1114 - RNA, 19 nt, artificial
  Chemically synthesized
auagacuuaugaucauggu

SEQ ID NO: 1115 - RNA, 19 nt, artificial
  Chemically synthesized
aauucccuuggauaccaag

SEQ ID NO: 1116 - RNA, 19 nt, artificial
  Chemically synthesized
uguuuccuaaugaacuaag

SEQ ID NO: 1117 - RNA, 19 nt, artificial
  Chemically synthesized
auuccacggaacuuguaac

SEQ ID NO: 1118 - RNA, 19 nt, artificial
  Chemically synthesized
gaugccaaaugauuuugcc

SEQ ID NO: 1119 - RNA, 19 nt, artificial
  Chemically synthesized
auuguuguugcuaacaucu

SEQ ID NO: 1120 - RNA, 19 nt, artificial
  Chemically synthesized
aauacacagcacuuuuuuc

SEQ ID NO: 1121 - RNA, 19 nt, artificial
  Chemically synthesized
augcucuaaaauuaccaac

SEQ ID NO: 1122 - RNA, 19 nt, artificial
  Chemically synthesized
auuccgacaccgagaggcg

SEQ ID NO: 1123 - RNA, 19 nt, artificial
  Chemically synthesized
aagcagugaaagagcaaug

SEQ ID NO: 1124 - RNA, 19 nt, artificial
  Chemically synthesized
gucaucaaacucuaauucu

SEQ ID NO: 1125 - RNA, 19 nt, artificial
  Chemically synthesized
aucaaucaagacuuuggcc

SEQ ID NO: 1126 - RNA, 19 nt, artificial
  Chemically synthesized
ucgcaguuccaaacauucc

SEQ ID NO: 1127 - RNA, 19 nt, artificial
  Chemically synthesized
auaugcagccuccggauug

SEQ ID NO: 1128 - RNA, 19 nt, artificial
  Chemically synthesized
aauccuucccgcugagccu

SEQ ID NO: 1129 - RNA, 19 nt, artificial
  Chemically synthesized
acuuuuuucuaggaauagc

SEQ ID NO: 1130 - RNA, 19 nt, artificial
  Chemically synthesized
cuaaauguucaagacugcc

SEQ ID NO: 1131 - RNA, 19 nt, artificial
  Chemically synthesized
uuaaguucauuugugcugu

SEQ ID NO: 1132 - RNA, 19 nt, artificial
  Chemically synthesized
ucuccgguuuuuuccaaug

SEQ ID NO: 1133 - RNA, 19 nt, artificial
  Chemically synthesized
acacuguguauucgugugc

SEQ ID NO: 1134 - RNA, 19 nt, artificial
  Chemically synthesized
ugggagucacuauaggucu

SEQ ID NO: 1135 - RNA, 19 nt, artificial
  Chemically synthesized
cucaaaugacgguacaucc

SEQ ID NO: 1136 - RNA, 19 nt, artificial
  Chemically synthesized
aagguguccauauuuccca

SEQ ID NO: 1137 - RNA, 19 nt, artificial
  Chemically synthesized
aguucauacuugcaccacu

SEQ ID NO: 1138 - RNA, 19 nt, artificial
  Chemically synthesized
auuccauuggaugucagca

SEQ ID NO: 1139 - RNA, 19 nt, artificial
  Chemically synthesized
acagagcacagcacaugcc

SEQ ID NO: 1140 - RNA, 19 nt, artificial
  Chemically synthesized
uguuuucuacugugauucu

SEQ ID NO: 1141 - RNA, 19 nt, artificial
  Chemically synthesized
ucucaaugggcuccagaag

SEQ ID NO: 1142 - RNA, 19 nt, artificial
  Chemically synthesized
acacugggagaacuccgag

SEQ ID NO: 1143 - RNA, 19 nt, artificial
  Chemically synthesized
uccagguaggucuuggugu

SEQ ID NO: 1144 - RNA, 19 nt, artificial
  Chemically synthesized
uaggacuuuaucgcagcuc

SEQ ID NO: 1145 - RNA, 19 nt, artificial
  Chemically synthesized
ucaaguuccucaaggaagg

SEQ ID NO: 1146 - RNA, 19 nt, artificial
  Chemically synthesized
ucacacaccucuguagguc

SEQ ID NO: 1147 - RNA, 19 nt, artificial
  Chemically synthesized
uuuaucgcagcucucagau

SEQ ID NO: 1148 - RNA, 19 nt, artificial
  Chemically synthesized
uaacucugucauuaucaga

SEQ ID NO: 1149 - RNA, 19 nt, artificial
  Chemically synthesized
uauugcauuccuacugauu

SEQ ID NO: 1150 - RNA, 19 nt, artificial
  Chemically synthesized
cuuuuuucucaaugggcuc

SEQ ID NO: 1151 - RNA, 19 nt, artificial
  Chemically synthesized
uaaagugcucagaucauaa

SEQ ID NO: 1152 - RNA, 19 nt, artificial
  Chemically synthesized
uuuuggcucauagcucugu

SEQ ID NO: 1153 - RNA, 19 nt, artificial
  Chemically synthesized
cauuguucucaucaaaaag

SEQ ID NO: 1154 - RNA, 19 nt, artificial
  Chemically synthesized
cacugggagaacuccgagc

SEQ ID NO: 1155 - RNA, 19 nt, artificial
  Chemically synthesized
gguuuuguaaggauuuccc

SEQ ID NO: 1156 - RNA, 19 nt, artificial
  Chemically synthesized
acauucugaauugacuuca

SEQ ID NO: 1157 - RNA, 19 nt, artificial
  Chemically synthesized
aaugacgguacauccacgu

SEQ ID NO: 1158 - RNA, 19 nt, artificial
  Chemically synthesized
ucaaguugcuccuuagaaa

SEQ ID NO: 1159 - RNA, 19 nt, artificial
  Chemically synthesized
cuuugaaucuuagugaagg

SEQ ID NO: 1160 - RNA, 19 nt, artificial
  Chemically synthesized
ucaacccacaacuaccagu

SEQ ID NO: 1161 - RNA, 19 nt, artificial
  Chemically synthesized
uuucccacucucaggauuu

SEQ ID NO: 1162 - RNA, 19 nt, artificial
  Chemically synthesized
cuggaccauaagguucucc

SEQ ID NO: 1163 - RNA, 19 nt, artificial
  Chemically synthesized
ucacugagauccaaguauu

SEQ ID NO: 1164 - RNA, 19 nt, artificial
  Chemically synthesized
uagguaggacagagaaugc

SEQ ID NO: 1165 - RNA, 19 nt, artificial
  Chemically synthesized
uccagaagaaugagaaugg

SEQ ID NO: 1166 - RNA, 19 nt, artificial
  Chemically synthesized
caauccagaaaucugauuc

SEQ ID NO: 1167 - RNA, 19 nt, artificial
  Chemically synthesized
agcaucauuguucucauca

SEQ ID NO: 1168 - RNA, 19 nt, artificial
  Chemically synthesized
uaccaagggacuauauuca

SEQ ID NO: 1169 - RNA, 19 nt, artificial
  Chemically synthesized
aguugcuccuuagaaaacg

SEQ ID NO: 1170 - RNA, 19 nt, artificial
  Chemically synthesized
auuuccagugucuugggaa

SEQ ID NO: 1171 - RNA, 19 nt, artificial
  Chemically synthesized
uuccacuuuaccuggaucu

SEQ ID NO: 1172 - RNA, 19 nt, artificial
  Chemically synthesized
uaaaaccuuggaauaugca

SEQ ID NO: 1173 - RNA, 19 nt, artificial
  Chemically synthesized
gucuaaauguucaagacug

SEQ ID NO: 1174 - RNA, 19 nt, artificial
  Chemically synthesized
ugaaacaaacuuucaucgg

SEQ ID NO: 1175 - RNA, 19 nt, artificial
  Chemically synthesized
aagaaagaaugacacaguc

SEQ ID NO: 1176 - RNA, 19 nt, artificial
  Chemically synthesized
ugaagucccgcuuaugaag

SEQ ID NO: 1177 - RNA, 19 nt, artificial
  Chemically synthesized
uaaacaaggaaccagaaaa

SEQ ID NO: 1178 - RNA, 19 nt, artificial
  Chemically synthesized
augcugcuucauaugaagg

SEQ ID NO: 1179 - RNA, 19 nt, artificial
  Chemically synthesized
uuuucaauggagucaauga

SEQ ID NO: 1180 - RNA, 19 nt, artificial
  Chemically synthesized
cauauuucccacucucagg

SEQ ID NO: 1181 - RNA, 19 nt, artificial
  Chemically synthesized
uuauugcauuccuacugau

SEQ ID NO: 1182 - RNA, 19 nt, artificial
  Chemically synthesized
augaucaugguuaucucau

SEQ ID NO: 1183 - RNA, 19 nt, artificial
  Chemically synthesized
ucuccagcaguaaaauaug

SEQ ID NO: 1184 - RNA, 19 nt, artificial
  Chemically synthesized
uaaauaugggaaccuagga

SEQ ID NO: 1185 - RNA, 19 nt, artificial
  Chemically synthesized
auaccauugcggucacaag

SEQ ID NO: 1186 - RNA, 19 nt, artificial
  Chemically synthesized
auggagucaaugauauugu

SEQ ID NO: 1187 - RNA, 19 nt, artificial
  Chemically synthesized
aggaucagcaggaacagag

SEQ ID NO: 1188 - RNA, 19 nt, artificial
  Chemically synthesized
augccaaaugauuuugccu

SEQ ID NO: 1189 - RNA, 19 nt, artificial
  Chemically synthesized
uaacaauccagaaaucuga

SEQ ID NO: 1190 - RNA, 19 nt, artificial
  Chemically synthesized
augggauggagagucacac

SEQ ID NO: 1191 - RNA, 19 nt, artificial
  Chemically synthesized
cuagguaggacagagaaug

SEQ ID NO: 1192 - RNA, 19 nt, artificial
  Chemically synthesized
uuuaguaagcaaguccuca

SEQ ID NO: 1193 - RNA, 19 nt, artificial
  Chemically synthesized
gcagcucucagauuuaccc

SEQ ID NO: 1194 - RNA, 19 nt, artificial
  Chemically synthesized
aaacaaaugcaucauagca

SEQ ID NO: 1195 - RNA, 19 nt, artificial
  Chemically synthesized
uccagcaguaaaauaugcu

SEQ ID NO: 1196 - RNA, 19 nt, artificial
  Chemically synthesized
uaguuauugcauuccuacu

SEQ ID NO: 1197 - RNA, 19 nt, artificial
  Chemically synthesized
uucgugugcuggauaaguu

SEQ ID NO: 1198 - RNA, 19 nt, artificial
  Chemically synthesized
guccaaaucaguaucucgc

SEQ ID NO: 1199 - RNA, 19 nt, artificial
  Chemically synthesized
ugccaaaugauuuugccuu

SEQ ID NO: 1200 - RNA, 19 nt, artificial
  Chemically synthesized
aguuccaaacauuccacgg

SEQ ID NO: 1201 - RNA, 19 nt, artificial
  Chemically synthesized
agaucccaacuagacaaag

SEQ ID NO: 1202 - RNA, 19 nt, artificial
  Chemically synthesized
uggagguucacacaccucu

SEQ ID NO: 1203 - RNA, 19 nt, artificial
  Chemically synthesized
ucagaugacuuacauucug

SEQ ID NO: 1204 - RNA, 19 nt, artificial
  Chemically synthesized
ucaaguuuuucagagugag

SEQ ID NO: 1205 - RNA, 19 nt, artificial
  Chemically synthesized
caaacuuuuuggcucauag

SEQ ID NO: 1206 - RNA, 19 nt, artificial
  Chemically synthesized
ucacaaaguuuucagaaag

SEQ ID NO: 1207 - RNA, 19 nt, artificial
  Chemically synthesized
agucaccugagagaacgcc

SEQ ID NO: 1208 - RNA, 19 nt, artificial
  Chemically synthesized
aaguucuccagcuccugga

SEQ ID NO: 1209 - RNA, 19 nt, artificial
  Chemically synthesized
uccugugacauuccgacac

SEQ ID NO: 1210 - RNA, 19 nt, artificial
  Chemically synthesized
aacucuuucuguaagugaa

SEQ ID NO: 1211 - RNA, 19 nt, artificial
  Chemically synthesized
uucauuugugcuguuuccu

SEQ ID NO: 1212 - RNA, 19 nt, artificial
  Chemically synthesized
ugugaaaguaaacaaggaa

SEQ ID NO: 1213 - RNA, 19 nt, artificial
  Chemically synthesized
ugcaccacucacucuucac

SEQ ID NO: 1214 - RNA, 19 nt, artificial
  Chemically synthesized
aaugacacagucauugaga

SEQ ID NO: 1215 - RNA, 19 nt, artificial
  Chemically synthesized
uuuuccaaugaugccaaau

SEQ ID NO: 1216 - RNA, 19 nt, artificial
  Chemically synthesized
uugcuacagauuacaguug

SEQ ID NO: 1217 - RNA, 19 nt, artificial
  Chemically synthesized
uguugcucuugagaucagc

SEQ ID NO: 1218 - RNA, 19 nt, artificial
  Chemically synthesized
uuucauauaccacaggcca

SEQ ID NO: 1219 - RNA, 19 nt, artificial
  Chemically synthesized
aucaugguuaucucauaga

SEQ ID NO: 1220 - RNA, 19 nt, artificial
  Chemically synthesized
gcaaugggcacaaugagcc

SEQ ID NO: 1221 - RNA, 19 nt, artificial
  Chemically synthesized
caaaugaaguuauugccac

SEQ ID NO: 1222 - RNA, 19 nt, artificial
  Chemically synthesized
gugaaaguaaacaaggaac

SEQ ID NO: 1223 - RNA, 19 nt, artificial
  Chemically synthesized
uguuaauuccauuggaugu

SEQ ID NO: 1224 - RNA, 19 nt, artificial
  Chemically synthesized
cuuaugaagacacaacuug

SEQ ID NO: 1225 - RNA, 19 nt, artificial
  Chemically synthesized
guuuucagaaagcacaaag

SEQ ID NO: 1226 - RNA, 19 nt, artificial
  Chemically synthesized
ugaaaugagucaaguugcu

SEQ ID NO: 1227 - RNA, 19 nt, artificial
  Chemically synthesized
ugcucuugagaucagcugc

SEQ ID NO: 1228 - RNA, 19 nt, artificial
  Chemically synthesized
agcucuguagaucugaagc

SEQ ID NO: 1229 - RNA, 19 nt, artificial
  Chemically synthesized
agucaaccaacuguggauc

SEQ ID NO: 1230 - RNA, 19 nt, artificial
  Chemically synthesized
aucagaugacuuacauucu

SEQ ID NO: 1231 - RNA, 19 nt, artificial
  Chemically synthesized
aucuuagugaaggugucca

SEQ ID NO: 1232 - RNA, 19 nt, artificial
  Chemically synthesized
agaagaaugagaauggcag

SEQ ID NO: 1233 - RNA, 19 nt, artificial
  Chemically synthesized
auggcagcaucauuguucu

SEQ ID NO: 1234 - RNA, 19 nt, artificial
  Chemically synthesized
agucacuauaggucuccuu

SEQ ID NO: 1235 - RNA, 19 nt, artificial
  Chemically synthesized
uccuacugauuuucaauac

SEQ ID NO: 1236 - RNA, 19 nt, artificial
  Chemically synthesized
ugauuggaggauucuuccu

SEQ ID NO: 1237 - RNA, 19 nt, artificial
  Chemically synthesized
agagaagccugauuggagg

SEQ ID NO: 1238 - RNA, 19 nt, artificial
  Chemically synthesized
uuucacugagauccaagua

SEQ ID NO: 1239 - RNA, 19 nt, artificial
  Chemically synthesized
uaucucgcaguuccaaaca

SEQ ID NO: 1240 - RNA, 19 nt, artificial
  Chemically synthesized
uuaucgcagcucucagauu

SEQ ID NO: 1241 - RNA, 19 nt, artificial
  Chemically synthesized
uggaugucagcaccagagc

SEQ ID NO: 1242 - RNA, 19 nt, artificial
  Chemically synthesized
augaagacacaacuugaag

SEQ ID NO: 1243 - RNA, 19 nt, artificial
  Chemically synthesized
uuccuuggagaggcugaug

SEQ ID NO: 1244 - RNA, 19 nt, artificial
  Chemically synthesized
aacagagcacagcacaugc

SEQ ID NO: 1245 - RNA, 19 nt, artificial
  Chemically synthesized
cuugcagauaccauugcgg

SEQ ID NO: 1246 - RNA, 19 nt, artificial
  Chemically synthesized
caaaguuuucagaaagcac

SEQ ID NO: 1247 - RNA, 19 nt, artificial
  Chemically synthesized
agaacgccgagcagccgcc

SEQ ID NO: 1248 - RNA, 19 nt, artificial
  Chemically synthesized
aacuccgagcagucaccug

SEQ ID NO: 1249 - RNA, 19 nt, artificial
  Chemically synthesized
ucugcauccaugaagucaa

SEQ ID NO: 1250 - RNA, 19 nt, artificial
  Chemically synthesized
uggcccucuauauccaugg

SEQ ID NO: 1251 - RNA, 19 nt, artificial
  Chemically synthesized
auauccauggguucugcau

SEQ ID NO: 1252 - RNA, 19 nt, artificial
  Chemically synthesized
ugcauuccuacugauuuuc

SEQ ID NO: 1253 - RNA, 19 nt, artificial
  Chemically synthesized
aaugcaucauagcagaugu

SEQ ID NO: 1254 - RNA, 19 nt, artificial
  Chemically synthesized
aagucaaccaacuguggau

SEQ ID NO: 1255 - RNA, 19 nt, artificial
  Chemically synthesized
aaaugggagaaguccaguu

SEQ ID NO: 1256 - RNA, 19 nt, artificial
  Chemically synthesized
uucucaucaaaaagacgga

SEQ ID NO: 1257 - RNA, 19 nt, artificial
  Chemically synthesized
agaugcucuaaaauuacca

SEQ ID NO: 1258 - RNA, 19 nt, artificial
  Chemically synthesized
agaaaaaagagauguuucc

SEQ ID NO: 1259 - RNA, 19 nt, artificial
  Chemically synthesized
uuuggcucauagcucugua

SEQ ID NO: 1260 - RNA, 19 nt, artificial
  Chemically synthesized
ucaaguauucuucaaccau

SEQ ID NO: 1261 - RNA, 19 nt, artificial
  Chemically synthesized
ucuuaaguucauuugugcu

SEQ ID NO: 1262 - RNA, 19 nt, artificial
  Chemically synthesized
gacuggucuuaaauauggg

SEQ ID NO: 1263 - RNA, 19 nt, artificial
  Chemically synthesized
agaggagucucuuagcagg

SEQ ID NO: 1264 - RNA, 19 nt, artificial
  Chemically synthesized
agugaauauaaagugcuca

SEQ ID NO: 1265 - RNA, 19 nt, artificial
  Chemically synthesized
guaagugaauauaaagugc

SEQ ID NO: 1266 - RNA, 19 nt, artificial
  Chemically synthesized
acagucaucaaacucuaau

SEQ ID NO: 1267 - RNA, 19 nt, artificial
  Chemically synthesized
aagccugauuggaggauuc

SEQ ID NO: 1268 - RNA, 19 nt, artificial
  Chemically synthesized
ucaucggugauuuucacau

SEQ ID NO: 1269 - RNA, 19 nt, artificial
  Chemically synthesized
aggucuccuuuggauccug

SEQ ID NO: 1270 - RNA, 19 nt, artificial
  Chemically synthesized
aaccaauucccuuggauac

SEQ ID NO: 1271 - RNA, 19 nt, artificial
  Chemically synthesized
uugugagaugagaaaaaag

SEQ ID NO: 1272 - RNA, 19 nt, artificial
  Chemically synthesized
ucagaugcucuaaaauuac

SEQ ID NO: 1273 - RNA, 19 nt, artificial
  Chemically synthesized
guaucucgcaguuccaaac

SEQ ID NO: 1274 - RNA, 19 nt, artificial
  Chemically synthesized
gcuuccaaagucuucagug

SEQ ID NO: 1275 - RNA, 19 nt, artificial
  Chemically synthesized
guguucauuaucuuccgca

SEQ ID NO: 1276 - RNA, 19 nt, artificial
  Chemically synthesized
acucugucauuaucagaug

SEQ ID NO: 1277 - RNA, 19 nt, artificial
  Chemically synthesized
ucaggauuugcaauuuugu

SEQ ID NO: 1278 - RNA, 19 nt, artificial
  Chemically synthesized
acucucaggauuugcaauu

SEQ ID NO: 1279 - RNA, 19 nt, artificial
  Chemically synthesized
acaucuaaaauuuccagug

SEQ ID NO: 1280 - RNA, 19 nt, artificial
  Chemically synthesized
uugcuccuuagaaaacgua

SEQ ID NO: 1281 - RNA, 19 nt, artificial
  Chemically synthesized
acuccagguaggucuuggu

SEQ ID NO: 1282 - RNA, 19 nt, artificial
  Chemically synthesized
auccaugaagucaaccaac

SEQ ID NO: 1283 - RNA, 19 nt, artificial
  Chemically synthesized
ucaugguuaucucauagaa

SEQ ID NO: 1284 - RNA, 19 nt, artificial
  Chemically synthesized
uagcagauguuccugcugg

SEQ ID NO: 1285 - RNA, 19 nt, artificial
  Chemically synthesized
aaccagaaaaacuuuacug

SEQ ID NO: 1286 - RNA, 19 nt, artificial
  Chemically synthesized
aagugaauauaaagugcuc

SEQ ID NO: 1287 - RNA, 19 nt, artificial
  Chemically synthesized
auucacaggagcaaaugaa

SEQ ID NO: 1288 - RNA, 19 nt, artificial
  Chemically synthesized
agcuccuggaccauaaggu

SEQ ID NO: 1289 - RNA, 19 nt, artificial
  Chemically synthesized
uccuggaccauaagguucu

SEQ ID NO: 1290 - RNA, 19 nt, artificial
  Chemically synthesized
auugccaccagcuuccaaa

SEQ ID NO: 1291 - RNA, 19 nt, artificial
  Chemically synthesized
uuaguaagcaaguccucaa

SEQ ID NO: 1292 - RNA, 19 nt, artificial
  Chemically synthesized
aaaguguccaaaucaguau

SEQ ID NO: 1293 - RNA, 19 nt, artificial
  Chemically synthesized
agaaucuuccucuauugug

SEQ ID NO: 1294 - RNA, 19 nt, artificial
  Chemically synthesized
acauaaagaucccaacuag

SEQ ID NO: 1295 - RNA, 19 nt, artificial
  Chemically synthesized
uuguggcucuuuucaaugg

SEQ ID NO: 1296 - RNA, 19 nt, artificial
  Chemically synthesized
cuucagugugugaaaugag

SEQ ID NO: 1297 - RNA, 19 nt, artificial
  Chemically synthesized
auugcauuccuacugauuu

SEQ ID NO: 1298 - RNA, 19 nt, artificial
  Chemically synthesized
cacuuggucacuaagagcu

SEQ ID NO: 1299 - RNA, 19 nt, artificial
  Chemically synthesized
ugcuguuuccuaaugaacu

SEQ ID NO: 1300 - RNA, 19 nt, artificial
  Chemically synthesized
ugaaaaauggaaagugucc

SEQ ID NO: 1301 - RNA, 19 nt, artificial
  Chemically synthesized
gaauguuaaagaagaaagg

SEQ ID NO: 1302 - RNA, 19 nt, artificial
  Chemically synthesized
uuugcuggccaaucaauca

SEQ ID NO: 1303 - RNA, 19 nt, artificial
  Chemically synthesized
ucgugugcuggauaaguuc

SEQ ID NO: 1304 - RNA, 19 nt, artificial
  Chemically synthesized
acuccauuaaggguacagu

SEQ ID NO: 1305 - RNA, 19 nt, artificial
  Chemically synthesized
ucuugguguucauuaucuu

SEQ ID NO: 1306 - RNA, 19 nt, artificial
  Chemically synthesized
cacuccagguaggucuugg

SEQ ID NO: 1307 - RNA, 19 nt, artificial
  Chemically synthesized
aggauuugcaauuuuguga

SEQ ID NO: 1308 - RNA, 19 nt, artificial
  Chemically synthesized
uaagcaaguccucaaauga

SEQ ID NO: 1309 - RNA, 19 nt, artificial
  Chemically synthesized
uagugacauaaagauccca

SEQ ID NO: 1310 - RNA, 19 nt, artificial
  Chemically synthesized
ugagagaacgccgagcagc

SEQ ID NO: 1311 - RNA, 19 nt, artificial
  Chemically synthesized
ucaucaacuuauuucugga

SEQ ID NO: 1312 - RNA, 19 nt, artificial
  Chemically synthesized
uucaucggugauuuucaca

SEQ ID NO: 1313 - RNA, 19 nt, artificial
  Chemically synthesized
ccaacuagacaaagacugg

SEQ ID NO: 1314 - RNA, 19 nt, artificial
  Chemically synthesized
cuuuuuggcucauagcucu

SEQ ID NO: 1315 - RNA, 19 nt, artificial
  Chemically synthesized
agacuuaugaucaugguua

SEQ ID NO: 1316 - RNA, 19 nt, artificial
  Chemically synthesized
gugaaggagaggaauucac

SEQ ID NO: 1317 - RNA, 19 nt, artificial
  Chemically synthesized
cacaucauuuucauauacc

SEQ ID NO: 1318 - RNA, 19 nt, artificial
  Chemically synthesized
ugcugcuccugagugaagg

SEQ ID NO: 1319 - RNA, 19 nt, artificial
  Chemically synthesized
uguuguuggacaggucaag

SEQ ID NO: 1320 - RNA, 19 nt, artificial
  Chemically synthesized
aaugaauuuguuucaccag

SEQ ID NO: 1321 - RNA, 19 nt, artificial
  Chemically synthesized
uacuugcaccacucacucu

SEQ ID NO: 1322 - RNA, 19 nt, artificial
  Chemically synthesized
auuucaucuuuucuggcca

SEQ ID NO: 1323 - RNA, 19 nt, artificial
  Chemically synthesized
ugcuacagauuacaguugg

SEQ ID NO: 1324 - RNA, 19 nt, artificial
  Chemically synthesized
aucagcugcacagagaagu

SEQ ID NO: 1325 - RNA, 19 nt, artificial
  Chemically synthesized
aaugaaguuauugccacca

SEQ ID NO: 1326 - RNA, 19 nt, artificial
  Chemically synthesized
uuccaaugaugccaaauga

SEQ ID NO: 1327 - RNA, 19 nt, artificial
  Chemically synthesized
cauaagguucuccacccag

SEQ ID NO: 1328 - RNA, 19 nt, artificial
  Chemically synthesized
auuuguuucaccaguggau

SEQ ID NO: 1329 - RNA, 19 nt, artificial
  Chemically synthesized
ucccaacuagacaaagacu

SEQ ID NO: 1330 - RNA, 19 nt, artificial
  Chemically synthesized
aauugagauuguuguugcu

SEQ ID NO: 1331 - RNA, 19 nt, artificial
  Chemically synthesized
aguucuuugaguugcggca

SEQ ID NO: 1332 - RNA, 19 nt, artificial
  Chemically synthesized
uaccuggaucuauaacucu

SEQ ID NO: 1333 - RNA, 19 nt, artificial
  Chemically synthesized
auugucaaugauccacuug

SEQ ID NO: 1334 - RNA, 19 nt, artificial
  Chemically synthesized
uaccauugcggucacaaga

SEQ ID NO: 1335 - RNA, 19 nt, artificial
  Chemically synthesized
acuuuaucgcagcucucag

SEQ ID NO: 1336 - RNA, 19 nt, artificial
  Chemically synthesized
gaagacacaacuugaaggg

SEQ ID NO: 1337 - RNA, 19 nt, artificial
  Chemically synthesized
cuacagauuacaguuggcc

SEQ ID NO: 1338 - RNA, 19 nt, artificial
  Chemically synthesized
guuaauuccauuggauguc

SEQ ID NO: 1339 - RNA, 19 nt, artificial
  Chemically synthesized
gugaaaugagucaaguugc

SEQ ID NO: 1340 - RNA, 19 nt, artificial
  Chemically synthesized
ugucugaaugaacuuaacu

SEQ ID NO: 1341 - RNA, 19 nt, artificial
  Chemically synthesized
acuuucaucggugauuuuc

SEQ ID NO: 1342 - RNA, 19 nt, artificial
  Chemically synthesized
acagcuagguaggacagag

SEQ ID NO: 1343 - RNA, 19 nt, artificial
  Chemically synthesized
uauguggcauuguccagug

SEQ ID NO: 1344 - RNA, 19 nt, artificial
  Chemically synthesized
uauuucccacucucaggau

SEQ ID NO: 1345 - RNA, 19 nt, artificial
  Chemically synthesized
gcuuuuuucucaaugggcu

SEQ ID NO: 1346 - RNA, 19 nt, artificial
  Chemically synthesized
agucuaaauguucaagacu

SEQ ID NO: 1347 - RNA, 19 nt, artificial
  Chemically synthesized
aagacccacaccauccaca

SEQ ID NO: 1348 - RNA, 19 nt, artificial
  Chemically synthesized
uuuguuucaccaguggaua

SEQ ID NO: 1349 - RNA, 19 nt, artificial
  Chemically synthesized
ugugugaaaugagucaagu

SEQ ID NO: 1350 - RNA, 19 nt, artificial
  Chemically synthesized
ugcaucauagcagauguuc

SEQ ID NO: 1351 - RNA, 19 nt, artificial
  Chemically synthesized
agaaaaagaaucuuccucu

SEQ ID NO: 1352 - RNA, 19 nt, artificial
  Chemically synthesized
cuuaaauaugggaaccuag

SEQ ID NO: 1353 - RNA, 19 nt, artificial
  Chemically synthesized
aaacuuucaucggugauuu

SEQ ID NO: 1354 - RNA, 19 nt, artificial
  Chemically synthesized
aagaaaaagaaucuuccuc

SEQ ID NO: 1355 - RNA, 19 nt, artificial
  Chemically synthesized
cacaaagacaguuuugugg

SEQ ID NO: 1356 - RNA, 19 nt, artificial
  Chemically synthesized
agucauugagaaucuuaag

SEQ ID NO: 1357 - RNA, 19 nt, artificial
  Chemically synthesized
uuuuguggccacagaggag

SEQ ID NO: 1358 - RNA, 19 nt, artificial
  Chemically synthesized
ugauccacuugccaggaau

SEQ ID NO: 1359 - RNA, 19 nt, artificial
  Chemically synthesized
aucagcaggaacagagcac

SEQ ID NO: 1360 - RNA, 19 nt, artificial
  Chemically synthesized
ugauccuguuguuggacag

SEQ ID NO: 1361 - RNA, 19 nt, artificial
  Chemically synthesized
cagagaaugccuuuugugg

SEQ ID NO: 1362 - RNA, 19 nt, artificial
  Chemically synthesized
acggaaaugggagaagucc

SEQ ID NO: 1363 - RNA, 19 nt, artificial
  Chemically synthesized
ugggagaacuccgagcagu

SEQ ID NO: 1364 - RNA, 19 nt, artificial
  Chemically synthesized
ucuaacaauccagaaaucu

SEQ ID NO: 1365 - RNA, 19 nt, artificial
  Chemically synthesized
guucuccagcuccuggacc

SEQ ID NO: 1366 - RNA, 19 nt, artificial
  Chemically synthesized
aagagcaaugggcacaaug

SEQ ID NO: 1367 - RNA, 19 nt, artificial
  Chemically synthesized
augaugccaaaugauuuug

SEQ ID NO: 1368 - RNA, 19 nt, artificial
  Chemically synthesized
ugaucaugguuaucucaua

SEQ ID NO: 1369 - RNA, 19 nt, artificial
  Chemically synthesized
acuuggucacuaagagcuc

SEQ ID NO: 1370 - RNA, 19 nt, artificial
  Chemically synthesized
ugcacagagaagugacagc

SEQ ID NO: 1371 - RNA, 19 nt, artificial
  Chemically synthesized
ggauccugcaaccaauucc

SEQ ID NO: 1372 - RNA, 19 nt, artificial
  Chemically synthesized
ccucaaggaagguaagucc

SEQ ID NO: 1373 - RNA, 19 nt, artificial
  Chemically synthesized
uaagagggaggcaucuggu

SEQ ID NO: 1374 - RNA, 19 nt, artificial
  Chemically synthesized
uccaugaagucaaccaacu

SEQ ID NO: 1375 - RNA, 19 nt, artificial
  Chemically synthesized
uugagauuguuguugcuaa

SEQ ID NO: 1376 - RNA, 19 nt, artificial
  Chemically synthesized
caaccaucaaauuuucacu

SEQ ID NO: 1377 - RNA, 19 nt, artificial
  Chemically synthesized
ucaaggaagguaaguccag

SEQ ID NO: 1378 - RNA, 19 nt, artificial
  Chemically synthesized
ucacaggcugaauuuuuca

SEQ ID NO: 1379 - RNA, 19 nt, artificial
  Chemically synthesized
uuucaucuuuucuggccac

SEQ ID NO: 1380 - RNA, 19 nt, artificial
  Chemically synthesized
cuucugugagcccugaggg

SEQ ID NO: 1381 - RNA, 19 nt, artificial
  Chemically synthesized
ccuuggaauaugcagccuc

SEQ ID NO: 1382 - RNA, 19 nt, artificial
  Chemically synthesized
uuccgacaccgagaggcgg

SEQ ID NO: 1383 - RNA, 19 nt, artificial
  Chemically synthesized
accaauucccuuggauacc

SEQ ID NO: 1384 - RNA, 19 nt, artificial
  Chemically synthesized
accaauuuuuaaaucuggc

SEQ ID NO: 1385 - RNA, 19 nt, artificial
  Chemically synthesized
ucaccaguggauaguucug

SEQ ID NO: 1386 - RNA, 19 nt, artificial
  Chemically synthesized
cuuaacuauaacuagugac

SEQ ID NO: 1387 - RNA, 19 nt, artificial
  Chemically synthesized
uguaggucacuguugcuaa

SEQ ID NO: 1388 - RNA, 19 nt, artificial
  Chemically synthesized
accaacuccauuaagggua

SEQ ID NO: 1389 - RNA, 19 nt, artificial
  Chemically synthesized
ucaaaugacgguacaucca

SEQ ID NO: 1390 - RNA, 19 nt, artificial
  Chemically synthesized
aguucugaaaaauggaaag

SEQ ID NO: 1391 - RNA, 19 nt, artificial
  Chemically synthesized
gucuccuuuggauccugcu

SEQ ID NO: 1392 - RNA, 19 nt, artificial
  Chemically synthesized
aacauggguaagagggagg

SEQ ID NO: 1393 - RNA, 19 nt, artificial
  Chemically synthesized
cucuucacaaaguuuucag

SEQ ID NO: 1394 - RNA, 19 nt, artificial
  Chemically synthesized
uccagugucuugggaaugc

SEQ ID NO: 1395 - RNA, 19 nt, artificial
  Chemically synthesized
uugcaauuuugugagauga

SEQ ID NO: 1396 - RNA, 19 nt, artificial
  Chemically synthesized
cagauaucaguaauagacu

SEQ ID NO: 1397 - RNA, 19 nt, artificial
  Chemically synthesized
ucuucacaaaguuuucaga

SEQ ID NO: 1398 - RNA, 19 nt, artificial
  Chemically synthesized
gcaucauagcagauguucc

SEQ ID NO: 1399 - RNA, 19 nt, artificial
  Chemically synthesized
uucuaacaauccagaaauc

SEQ ID NO: 1400 - RNA, 19 nt, artificial
  Chemically synthesized
gguacagucaucaaacucu

SEQ ID NO: 1401 - RNA, 19 nt, artificial
  Chemically synthesized
ugugagaugagaaaaaaga

SEQ ID NO: 1402 - RNA, 19 nt, artificial
  Chemically synthesized
uucauacuugcaccacuca

SEQ ID NO: 1403 - RNA, 19 nt, artificial
  Chemically synthesized
uagucaaguuuuucagagu

SEQ ID NO: 1404 - RNA, 19 nt, artificial
  Chemically synthesized
acccacaccauccacaaag

SEQ ID NO: 1405 - RNA, 19 nt, artificial
  Chemically synthesized
caacaccaaacacugggag

SEQ ID NO: 1406 - RNA, 19 nt, artificial
  Chemically synthesized
uuuguggccacagaggagu

SEQ ID NO: 1407 - RNA, 19 nt, artificial
  Chemically synthesized
uacaaaaaucuccagcagu

SEQ ID NO: 1408 - RNA, 19 nt, artificial
  Chemically synthesized
uaaggauuucccaguaagu

SEQ ID NO: 1409 - RNA, 19 nt, artificial
  Chemically synthesized
aaggaagguaaguccagca

SEQ ID NO: 1410 - RNA, 19 nt, artificial
  Chemically synthesized
ucucgcaguuccaaacauu

SEQ ID NO: 1411 - RNA, 19 nt, artificial
  Chemically synthesized
uaccaacuccauuaagggu

SEQ ID NO: 1412 - RNA, 19 nt, artificial
  Chemically synthesized
aacuaccaguugaaagcag

SEQ ID NO: 1413 - RNA, 19 nt, artificial
  Chemically synthesized
caacuagacaaagacuggu

SEQ ID NO: 1414 - RNA, 19 nt, artificial
  Chemically synthesized
cuagugacauaaagauccc

SEQ ID NO: 1415 - RNA, 19 nt, artificial
  Chemically synthesized
aaguccagcaaaaucuuuu

SEQ ID NO: 1416 - RNA, 19 nt, artificial
  Chemically synthesized
agcaaugggcacaaugagc

SEQ ID NO: 1417 - RNA, 19 nt, artificial
  Chemically synthesized
uccuuggagaggcugauga

SEQ ID NO: 1418 - RNA, 19 nt, artificial
  Chemically synthesized
acaaggaaccagaaaaacu

SEQ ID NO: 1419 - RNA, 19 nt, artificial
  Chemically synthesized
ugcaauuuugugagaugag

SEQ ID NO: 1420 - RNA, 19 nt, artificial
  Chemically synthesized
uggauaguucugaaaaaug

SEQ ID NO: 1421 - RNA, 19 nt, artificial
  Chemically synthesized
gaaaugagucaaguugcuc

SEQ ID NO: 1422 - RNA, 19 nt, artificial
  Chemically synthesized
ggagucacuauaggucucc

SEQ ID NO: 1423 - RNA, 19 nt, artificial
  Chemically synthesized
acuggucuuaaauauggga

SEQ ID NO: 1424 - RNA, 19 nt, artificial
  Chemically synthesized
uagagagggccaggcaucc

SEQ ID NO: 1425 - RNA, 19 nt, artificial
  Chemically synthesized
cuauauccauggguucugc

SEQ ID NO: 1426 - RNA, 19 nt, artificial
  Chemically synthesized
ugagaucagcugcacagag

SEQ ID NO: 1427 - RNA, 19 nt, artificial
  Chemically synthesized
ucaauggagucaaugauau

SEQ ID NO: 1428 - RNA, 19 nt, artificial
  Chemically synthesized
uuucaggcauagaaugaaa

SEQ ID NO: 1429 - RNA, 19 nt, artificial
  Chemically synthesized
uuuccagugucuugggaau

SEQ ID NO: 1430 - RNA, 19 nt, artificial
  Chemically synthesized
cuauaggucuccuuuggau

SEQ ID NO: 1431 - RNA, 19 nt, artificial
  Chemically synthesized
augaacuaagccaguugcu

SEQ ID NO: 1432 - RNA, 19 nt, artificial
  Chemically synthesized
aagguucuccacccaguag

SEQ ID NO: 1433 - RNA, 19 nt, artificial
  Chemically synthesized
uugccaccagcuuccaaag

SEQ ID NO: 1434 - RNA, 19 nt, artificial
  Chemically synthesized
auaugcugcuucauaugaa

SEQ ID NO: 1435 - RNA, 19 nt, artificial
  Chemically synthesized
gagaauggcagcaucauug

SEQ ID NO: 1436 - RNA, 19 nt, artificial
  Chemically synthesized
gaacuaagccaguugcuac

SEQ ID NO: 1437 - RNA, 19 nt, artificial
  Chemically synthesized
uuguuucaccaguggauag

SEQ ID NO: 1438 - RNA, 19 nt, artificial
  Chemically synthesized
acaccucuguaggucacug

SEQ ID NO: 1439 - RNA, 19 nt, artificial
  Chemically synthesized
gagcaaaugaaguuauugc

SEQ ID NO: 1440 - RNA, 19 nt, Artificial Sequence
  Chemically synthesized
guuuuuuccaaugaugcca

SEQ ID NO: 1441 - RNA, 19 nt, artificial
  Chemically synthesized
gcccauugagaaaaaagcc

SEQ ID NO: 1442 - RNA, 19 nt, artificial
  Chemically synthesized
agcucaggaucuuuaaacu

SEQ ID NO: 1443 - RNA, 19 nt, artificial
  Chemically synthesized
gguccugugccaccguuuc

SEQ ID NO: 1444 - RNA, 19 nt, artificial
  Chemically synthesized
gcaacagugaccuacagag

SEQ ID NO: 1445 - RNA, 19 nt, artificial
  Chemically synthesized
aguguaacaggcugcauuc

SEQ ID NO: 1446 - RNA, 19 nt, artificial
  Chemically synthesized
acaaguuccguggaauguu

SEQ ID NO: 1447 - RNA, 19 nt, artificial
  Chemically synthesized
gaaaugugaaaaucaccga

SEQ ID NO: 1448 - RNA, 19 nt, artificial
  Chemically synthesized
gggaaauauggacaccuuc

SEQ ID NO: 1449 - RNA, 19 nt, artificial
  Chemically synthesized
uggaucauugacaauauca

SEQ ID NO: 1450 - RNA, 19 nt, artificial
  Chemically synthesized
gacaccuucacuaagauuc

SEQ ID NO: 1451 - RNA, 19 nt, artificial
  Chemically synthesized
caggcugcauucccaagac

SEQ ID NO: 1452 - RNA, 19 nt, artificial
  Chemically synthesized
uuuuacugcuggagauuuu

SEQ ID NO: 1453 - RNA, 19 nt, artificial
  Chemically synthesized
cauccaauggaauuaacac

SEQ ID NO: 1454 - RNA, 19 nt, artificial
  Chemically synthesized
ugacuguacccuuaaugga

SEQ ID NO: 1455 - RNA, 19 nt, artificial
  Chemically synthesized
acagugagcgggaugccua

SEQ ID NO: 1456 - RNA, 19 nt, artificial
  Chemically synthesized
gccuggcuccaggccaaaa

SEQ ID NO: 1457 - RNA, 19 nt, artificial
  Chemically synthesized
aggaucaccuacauuagca

SEQ ID NO: 1458 - RNA, 19 nt, artificial
  Chemically synthesized
uguaagucaucugauccuu

SEQ ID NO: 1459 - RNA, 19 nt, artificial
  Chemically synthesized
agauaaugaacaccaagac

SEQ ID NO: 1460 - RNA, 19 nt, artificial
  Chemically synthesized
aaguggaucauugacaaua

SEQ ID NO: 1461 - RNA, 19 nt, artificial
  Chemically synthesized
gcuccaggccaaaaggaag

SEQ ID NO: 1462 - RNA, 19 nt, artificial
  Chemically synthesized
gcugcggaagauaaugaac

SEQ ID NO: 1463 - RNA, 19 nt, artificial
  Chemically synthesized
gacaauaucauugacucca

SEQ ID NO: 1464 - RNA, 19 nt, artificial
  Chemically synthesized
auuuguuucuuacagugag

SEQ ID NO: 1465 - RNA, 19 nt, artificial
  Chemically synthesized
acugcgagauacugauuug

SEQ ID NO: 1466 - RNA, 19 nt, artificial
  Chemically synthesized
agauugaugcuucagaucu

SEQ ID NO: 1467 - RNA, 19 nt, artificial
  Chemically synthesized
ggccuggcuccaggccaaa

SEQ ID NO: 1468 - RNA, 19 nt, artificial
  Chemically synthesized
ucuggugcugacauccaau

SEQ ID NO: 1469 - RNA, 19 nt, artificial
  Chemically synthesized
gaugccuacuggguggaga

SEQ ID NO: 1470 - RNA, 19 nt, artificial
  Chemically synthesized
gagcuggagaacuucaauc

SEQ ID NO: 1471 - RNA, 19 nt, artificial
  Chemically synthesized
gaauacacaguguaacagg

SEQ ID NO: 1472 - RNA, 19 nt, artificial
  Chemically synthesized
cacaguguaacaggcugca

SEQ ID NO: 1473 - RNA, 19 nt, artificial
  Chemically synthesized
gguucaggauguccgccuc

SEQ ID NO: 1474 - RNA, 19 nt, artificial
  Chemically synthesized
agcaacagugaccuacaga

SEQ ID NO: 1475 - RNA, 19 nt, artificial
  Chemically synthesized
gacuguacccuuaauggag

SEQ ID NO: 1476 - RNA, 19 nt, artificial
  Chemically synthesized
gccacauacuuuguggaug

SEQ ID NO: 1477 - RNA, 19 nt, artificial
  Chemically synthesized
agauuuugcuggacuuacc

SEQ ID NO: 1478 - RNA, 19 nt, artificial
  Chemically synthesized
guuagcaacaacaaucuca

SEQ ID NO: 1479 - RNA, 19 nt, artificial
  Chemically synthesized
ggcuucucugucuugugac

SEQ ID NO: 1480 - RNA, 19 nt, artificial
  Chemically synthesized
ccagcaaauuaccugugug

SEQ ID NO: 1481 - RNA, 19 nt, artificial
  Chemically synthesized
aagagugaguggugcaagu

SEQ ID NO: 1482 - RNA, 19 nt, artificial
  Chemically synthesized
agaaauaaguugaugacuc

SEQ ID NO: 1483 - RNA, 19 nt, artificial
  Chemically synthesized
agacacuggaaauuuuaga

SEQ ID NO: 1484 - RNA, 19 nt, artificial
  Chemically synthesized
agggcagcucaggaucuuu

SEQ ID NO: 1485 - RNA, 19 nt, artificial
  Chemically synthesized
ggaaauccuuacaaaaccc

SEQ ID NO: 1486 - RNA, 19 nt, artificial
  Chemically synthesized
ucagccucuccaaggaaga

SEQ ID NO: 1487 - RNA, 19 nt, artificial
  Chemically synthesized
uaugaucugagcacuuuau

SEQ ID NO: 1488 - RNA, 19 nt, artificial
  Chemically synthesized
acuucauuugcuccuguga

SEQ ID NO: 1489 - RNA, 19 nt, artificial
  Chemically synthesized
ugcuuucugaaaacuuugu

SEQ ID NO: 1490 - RNA, 19 nt, artificial
  Chemically synthesized
agagccacaaaacugucuu

SEQ ID NO: 1491 - RNA, 19 nt, artificial
  Chemically synthesized
gcacuggugucuggcaugu

SEQ ID NO: 1492 - RNA, 19 nt, artificial
  Chemically synthesized
gguaaaucugagagcugcg

SEQ ID NO: 1493 - RNA, 19 nt, artificial
  Chemically synthesized
ggaagauucuuuuucuucc

SEQ ID NO: 1494 - RNA, 19 nt, artificial
  Chemically synthesized
gauccagguaaaguggaaa

SEQ ID NO: 1495 - RNA, 19 nt, artificial
  Chemically synthesized
guggaucauugacaauauc

SEQ ID NO: 1496 - RNA, 19 nt, artificial
  Chemically synthesized
aaggaagaauccuccaauc

SEQ ID NO: 1497 - RNA, 19 nt, artificial
  Chemically synthesized
cacgaauacacaguguaac

SEQ ID NO: 1498 - RNA, 19 nt, artificial
  Chemically synthesized
ucauaugaagcagcauauu

SEQ ID NO: 1499 - RNA, 19 nt, artificial
  Chemically synthesized
ucugcaagcugcggaagau

SEQ ID NO: 1500 - RNA, 19 nt, artificial
  Chemically synthesized
ccacauacuuuguggaugg

SEQ ID NO: 1501 - RNA, 19 nt, artificial
  Chemically synthesized
gaagacuuuggaagcuggu

SEQ ID NO: 1502 - RNA, 19 nt, artificial
  Chemically synthesized
uagcaacaacaaucucaau

SEQ ID NO: 1503 - RNA, 19 nt, artificial
  Chemically synthesized
gcuucucugucuugugacc

SEQ ID NO: 1504 - RNA, 19 nt, artificial
  Chemically synthesized
ugaagagugaguggugcaa

SEQ ID NO: 1505 - RNA, 19 nt, artificial
  Chemically synthesized
uccuucauaugaagcagca

SEQ ID NO: 1506 - RNA, 19 nt, artificial
  Chemically synthesized
uggaagcugguggcaauaa

SEQ ID NO: 1507 - RNA, 19 nt, artificial
  Chemically synthesized
ugccuggcccucucuacaa

SEQ ID NO: 1508 - RNA, 19 nt, artificial
  Chemically synthesized
caggccaaaaggaagccca

SEQ ID NO: 1509 - RNA, 19 nt, artificial
  Chemically synthesized
cugguggcaauaacuucau

SEQ ID NO: 1510 - RNA, 19 nt, artificial
  Chemically synthesized
cagaucuacagagcuauga

SEQ ID NO: 1511 - RNA, 19 nt, artificial
  Chemically synthesized
cagaaauaaguugaugacu

SEQ ID NO: 1512 - RNA, 19 nt, artificial
  Chemically synthesized
ugaagacuuuggaagcugg

SEQ ID NO: 1513 - RNA, 19 nt, artificial
  Chemically synthesized
cucaggagcagcaagcacu

SEQ ID NO: 1514 - RNA, 19 nt, artificial
  Chemically synthesized
gacacuggaaauuuuagau

SEQ ID NO: 1515 - RNA, 19 nt, artificial
  Chemically synthesized
auaaugaacaccaagaccu

SEQ ID NO: 1516 - RNA, 19 nt, artificial
  Chemically synthesized
guuaaaagaaucacaguag

SEQ ID NO: 1517 - RNA, 19 nt, artificial
  Chemically synthesized
uccacuggugaaacaaauu

SEQ ID NO: 1518 - RNA, 19 nt, artificial
  Chemically synthesized
uggaacugcgagauacuga

SEQ ID NO: 1519 - RNA, 19 nt, artificial
  Chemically synthesized
auuuuacugcuggagauuu

SEQ ID NO: 1520 - RNA, 19 nt, artificial
  Chemically synthesized
gaagauaaugaacaccaag

SEQ ID NO: 1521 - RNA, 19 nt, artificial
  Chemically synthesized
gccagcaaauuaccugugu

SEQ ID NO: 1522 - RNA, 19 nt, artificial
  Chemically synthesized
gacuucauuccuggcaagu

SEQ ID NO: 1523 - RNA, 19 nt, artificial
  Chemically synthesized
ugugcucuguuccugcuga

SEQ ID NO: 1524 - RNA, 19 nt, artificial
  Chemically synthesized
agcuggagaacuucaaucc

SEQ ID NO: 1525 - RNA, 19 nt, artificial
  Chemically synthesized
ucccaagacacuggaaauu

SEQ ID NO: 1526 - RNA, 19 nt, artificial
  Chemically synthesized
aauauggacaccuucacua

SEQ ID NO: 1527 - RNA, 19 nt, artificial
  Chemically synthesized
cuucauuccuggcaagugg

SEQ ID NO: 1528 - RNA, 19 nt, artificial
  Chemically synthesized
gaccuguccaacaacagga

SEQ ID NO: 1529 - RNA, 19 nt, artificial
  Chemically synthesized
uuaccuuccuugaggaacu

SEQ ID NO: 1530 - RNA, 19 nt, artificial
  Chemically synthesized
augaucugagcacuuuaua

SEQ ID NO: 1531 - RNA, 19 nt, artificial
  Chemically synthesized
aaauccuuacaaaacccua

SEQ ID NO: 1532 - RNA, 19 nt, artificial
  Chemically synthesized
ugaugacucuaccagaugc

SEQ ID NO: 1533 - RNA, 19 nt, artificial
  Chemically synthesized
aguaugaacuggacuucuc

SEQ ID NO: 1534 - RNA, 19 nt, artificial
  Chemically synthesized
uaaggagcaacuugacuca

SEQ ID NO: 1535 - RNA, 19 nt, artificial
  Chemically synthesized
cagaguuauagauccaggu

SEQ ID NO: 1536 - RNA, 19 nt, artificial
  Chemically synthesized
agccaaaaaguuugaaguc

SEQ ID NO: 1537 - RNA, 19 nt, artificial
  Chemically synthesized
gagauugaugcuucagauc

SEQ ID NO: 1538 - RNA, 19 nt, artificial
  Chemically synthesized
cuacauuagcaacagugac

SEQ ID NO: 1539 - RNA, 19 nt, artificial
  Chemically synthesized
uucuuaaacuuacugggaa

SEQ ID NO: 1540 - RNA, 19 nt, artificial
  Chemically synthesized
uugaugacuguacccuuaa

SEQ ID NO: 1541 - RNA, 19 nt, artificial
  Chemically synthesized
gugcaaguaugaacuggac

SEQ ID NO: 1542 - RNA, 19 nt, artificial
  Chemically synthesized
ugaaaacuuugugaagagu

SEQ ID NO: 1543 - RNA, 19 nt, artificial
  Chemically synthesized
ggaauuaacacaauagagg

SEQ ID NO: 1544 - RNA, 19 nt, artificial
  Chemically synthesized
gaggaacuugagauugaug

SEQ ID NO: 1545 - RNA, 19 nt, artificial
  Chemically synthesized
ccagaaauaaguugaugac

SEQ ID NO: 1546 - RNA, 19 nt, artificial
  Chemically synthesized
uuaacacaauagaggaaga

SEQ ID NO: 1547 - RNA, 19 nt, artificial
  Chemically synthesized
cagcacuggugucuggcau

SEQ ID NO: 1548 - RNA, 19 nt, artificial
  Chemically synthesized
cagcacacgaauacacagu

SEQ ID NO: 1549 - RNA, 19 nt, artificial
  Chemically synthesized
acuuauccagcacacgaau

SEQ ID NO: 1550 - RNA, 19 nt, artificial
  Chemically synthesized
guuuucuaaggagcaacuu

SEQ ID NO: 1551 - RNA, 19 nt, artificial
  Chemically synthesized
guccaggagcuggagaacu

SEQ ID NO: 1552 - RNA, 19 nt, artificial
  Chemically synthesized
aaaacugucuuugugcuuu

SEQ ID NO: 1553 - RNA, 19 nt, artificial
  Chemically synthesized
aacuugagauugaugcuuc

SEQ ID NO: 1554 - RNA, 19 nt, artificial
  Chemically synthesized
gggaaacaucucuuuuuuc

SEQ ID NO: 1555 - RNA, 19 nt, artificial
  Chemically synthesized
uggugaaacaaauucauug

SEQ ID NO: 1556 - RNA, 19 nt, artificial
  Chemically synthesized
ugucaguggccagaaaaga

SEQ ID NO: 1557 - RNA, 19 nt, artificial
  Chemically synthesized
caagcugcggaagauaaug

SEQ ID NO: 1558 - RNA, 19 nt, artificial
  Chemically synthesized
aauuagaguuugaugacug

SEQ ID NO: 1559 - RNA, 19 nt, artificial
  Chemically synthesized
ugaaaaucaccgaugaaag

SEQ ID NO: 1560 - RNA, 19 nt, artificial
  Chemically synthesized
aagucaucugauccuucau

SEQ ID NO: 1561 - RNA, 19 nt, artificial
  Chemically synthesized
ugaaaagagccacaaaacu

SEQ ID NO: 1562 - RNA, 19 nt, artificial
  Chemically synthesized
ucauuugcuccugugaauu

SEQ ID NO: 1563 - RNA, 19 nt, artificial
  Chemically synthesized
guuuuucugguuccuuguu

SEQ ID NO: 1564 - RNA, 19 nt, artificial
  Chemically synthesized
aguugugucuucauaagcg

SEQ ID NO: 1565 - RNA, 19 nt, artificial
  Chemically synthesized
cuucucccauuuccgucuu

SEQ ID NO: 1566 - RNA, 19 nt, artificial
  Chemically synthesized
acacuuuccauuuuucaga

SEQ ID NO: 1567 - RNA, 19 nt, artificial
  Chemically synthesized
aacugcgagauacugauuu

SEQ ID NO: 1568 - RNA, 19 nt, artificial
  Chemically synthesized
caggcuucucugucuugug

SEQ ID NO: 1569 - RNA, 19 nt, artificial
  Chemically synthesized
caaaacugucuuugugcuu

SEQ ID NO: 1570 - RNA, 19 nt, artificial
  Chemically synthesized
acuauccacuggugaaaca

SEQ ID NO: 1571 - RNA, 19 nt, artificial
  Chemically synthesized
cauugacaauaucauugac

SEQ ID NO: 1572 - RNA, 19 nt, artificial
  Chemically synthesized
ucauuagaauacuuggauc

SEQ ID NO: 1573 - RNA, 19 nt, artificial
  Chemically synthesized
ugggaaauccuuacaaaac

SEQ ID NO: 1574 - RNA, 19 nt, artificial
  Chemically synthesized
cuggugucuggcaugugcu

SEQ ID NO: 1575 - RNA, 19 nt, artificial
  Chemically synthesized
caagggcagcucaggaucu

SEQ ID NO: 1576 - RNA, 19 nt, artificial
  Chemically synthesized
uaaguugaugacucuacca

SEQ ID NO: 1577 - RNA, 19 nt, artificial
  Chemically synthesized
ucucuuuuuucucaucuca

SEQ ID NO: 1578 - RNA, 19 nt, artificial
  Chemically synthesized
uccuugaggaacuugagau

SEQ ID NO: 1579 - RNA, 19 nt, artificial
  Chemically synthesized
gcuggacuuaccuuccuug

SEQ ID NO: 1580 - RNA, 19 nt, artificial
  Chemically synthesized
ucauaagcgggacuucauu

SEQ ID NO: 1581 - RNA, 19 nt, artificial
  Chemically synthesized
ucuacagagcuaugagcca

SEQ ID NO: 1582 - RNA, 19 nt, artificial
  Chemically synthesized
cgggacuucauuccuggca

SEQ ID NO: 1583 - RNA, 19 nt, artificial
  Chemically synthesized
acuggugaaacaaauucau

SEQ ID NO: 1584 - RNA, 19 nt, artificial
  Chemically synthesized
aaagauuuugcuggacuua

SEQ ID NO: 1585 - RNA, 19 nt, artificial
  Chemically synthesized
aaaagagccacaaaacugu

SEQ ID NO: 1586 - RNA, 19 nt, artificial
  Chemically synthesized
acuccauugaaaagagcca

SEQ ID NO: 1587 - RNA, 19 nt, artificial
  Chemically synthesized
gagaacaaugaugcugcca

SEQ ID NO: 1588 - RNA, 19 nt, artificial
  Chemically synthesized
aagcugcggaagauaauga

SEQ ID NO: 1589 - RNA, 19 nt, artificial
  Chemically synthesized
gcagcauauuuuacugcug

SEQ ID NO: 1590 - RNA, 19 nt, artificial
  Chemically synthesized
gucaucaucagccucucca

SEQ ID NO: 1591 - RNA, 19 nt, artificial
  Chemically synthesized
uggcccucucuacaaacuu

SEQ ID NO: 1592 - RNA, 19 nt, artificial
  Chemically synthesized
cugcaagggcagcucagga

SEQ ID NO: 1593 - RNA, 19 nt, artificial
  Chemically synthesized
cuccaaucaggcuucucug

SEQ ID NO: 1594 - RNA, 19 nt, artificial
  Chemically synthesized
cuuacccauguuacuagua

SEQ ID NO: 1595 - RNA, 19 nt, artificial
  Chemically synthesized
gaaaagagccacaaaacug

SEQ ID NO: 1596 - RNA, 19 nt, artificial
  Chemically synthesized
caggaucuuuaaacuccau

SEQ ID NO: 1597 - RNA, 19 nt, artificial
  Chemically synthesized
ccugugccaccguuuccau

SEQ ID NO: 1598 - RNA, 19 nt, artificial
  Chemically synthesized
cguggaauguuuggaacug

SEQ ID NO: 1599 - RNA, 19 nt, artificial
  Chemically synthesized
cgcuucugcaagcugcgga

SEQ ID NO: 1600 - RNA, 19 nt, artificial
  Chemically synthesized
ggugucggaaugucacagg

SEQ ID NO: 1601 - RNA, 19 nt, artificial
  Chemically synthesized
auuuccgucuuuuugauga

SEQ ID NO: 1602 - RNA, 19 nt, artificial
  Chemically synthesized
cauugacuccauugaaaag

SEQ ID NO: 1603 - RNA, 19 nt, artificial
  Chemically synthesized
uauuugaacuuauccagca

SEQ ID NO: 1604 - RNA, 19 nt, artificial
  Chemically synthesized
gucuucauaagcgggacuu

SEQ ID NO: 1605 - RNA, 19 nt, artificial
  Chemically synthesized
guggagaaccuuauggucc

SEQ ID NO: 1606 - RNA, 19 nt, artificial
  Chemically synthesized
agcagcaagcacuggccaa

SEQ ID NO: 1607 - RNA, 19 nt, artificial
  Chemically synthesized
agcugguggcaauaacuuc

SEQ ID NO: 1608 - RNA, 19 nt, artificial
  Chemically synthesized
agcacuggugucuggcaug

SEQ ID NO: 1609 - RNA, 19 nt, artificial
  Chemically synthesized
acacaauagaggaagauuc

SEQ ID NO: 1610 - RNA, 19 nt, artificial
  Chemically synthesized
gaagcagcauauuuuacug

SEQ ID NO: 1611 - RNA, 19 nt, artificial
  Chemically synthesized
aacacaauagaggaagauu

SEQ ID NO: 1612 - RNA, 19 nt, artificial
  Chemically synthesized
cuggcaugugcugugcucu

SEQ ID NO: 1613 - RNA, 19 nt, artificial
  Chemically synthesized
cgaugaaaguuuguuucag

SEQ ID NO: 1614 - RNA, 19 nt, artificial
  Chemically synthesized
gauccuucauaugaagcag

SEQ ID NO: 1615 - RNA, 19 nt, artificial
  Chemically synthesized
uucagaucuacagagcuau

SEQ ID NO: 1616 - RNA, 19 nt, artificial
  Chemically synthesized
cacucugaaaaacuugacu

SEQ ID NO: 1617 - RNA, 19 nt, artificial
  Chemically synthesized
gaugagaacaaugaugcug

SEQ ID NO: 1618 - RNA, 19 nt, artificial
  Chemically synthesized
ggugucuggcaugugcugu

SEQ ID NO: 1619 - RNA, 19 nt, artificial
  Chemically synthesized
ugauccuucauaugaagca

SEQ ID NO: 1620 - RNA, 19 nt, artificial
  Chemically synthesized
gcugugcucuguuccugcu

SEQ ID NO: 1621 - RNA, 19 nt, artificial
  Chemically synthesized
cagauuucuggauuguuag

SEQ ID NO: 1622 - RNA, 19 nt, artificial
  Chemically synthesized
cuuaaacuuacugggaaau

SEQ ID NO: 1623 - RNA, 19 nt, artificial
  Chemically synthesized
aaagccuugaccuguccaa

SEQ ID NO: 1624 - RNA, 19 nt, artificial
  Chemically synthesized
ccagaugccucccucuuac

SEQ ID NO: 1625 - RNA, 19 nt, artificial
  Chemically synthesized
aacuuacugggaaauccuu

SEQ ID NO: 1626 - RNA, 19 nt, artificial
  Chemically synthesized
uucauaagcgggacuucau

SEQ ID NO: 1627 - RNA, 19 nt, artificial
  Chemically synthesized
ggauggugugggucuuggg

SEQ ID NO: 1628 - RNA, 19 nt, artificial
  Chemically synthesized
acaaaacugucuuugugcu

SEQ ID NO: 1629 - RNA, 19 nt, artificial
  Chemically synthesized
uuuggaacugcgagauacu

SEQ ID NO: 1630 - RNA, 19 nt, artificial
  Chemically synthesized
augccucccucuuacccau

SEQ ID NO: 1631 - RNA, 19 nt, artificial
  Chemically synthesized
cugaagacuuuggaagcug

SEQ ID NO: 1632 - RNA, 19 nt, artificial
  Chemically synthesized
gccucccucuuacccaugu

SEQ ID NO: 1633 - RNA, 19 nt, artificial
  Chemically synthesized
caguagaaaacaguaaagu

SEQ ID NO: 1634 - RNA, 19 nt, artificial
  Chemically synthesized
aagaaaagauuuugcugga

SEQ ID NO: 1635 - RNA, 19 nt, artificial
  Chemically synthesized
ucuuuaaacuccauucccu

SEQ ID NO: 1636 - RNA, 19 nt, artificial
  Chemically synthesized
gaauguuuggaacugcgag

SEQ ID NO: 1637 - RNA, 19 nt, artificial
  Chemically synthesized
aagaaucacaguagaaaac

SEQ ID NO: 1638 - RNA, 19 nt, artificial
  Chemically synthesized
cacucaggagcagcaagca

SEQ ID NO: 1639 - RNA, 19 nt, artificial
  Chemically synthesized
auguuuggaacugcgagau

SEQ ID NO: 1640 - RNA, 19 nt, artificial
  Chemically synthesized
ccaggagcuggagaacuuc

SEQ ID NO: 1641 - RNA, 19 nt, artificial
  Chemically synthesized
gccuacuggguggagaacc

SEQ ID NO: 1642 - RNA, 19 nt, artificial
  Chemically synthesized
agaucuacagagcuaugag

SEQ ID NO: 1643 - RNA, 19 nt, artificial
  Chemically synthesized
acaauccggaggcugcaua

SEQ ID NO: 1644 - RNA, 19 nt, artificial
  Chemically synthesized
ugaacaccaagaccuaccu

SEQ ID NO: 1645 - RNA, 19 nt, artificial
  Chemically synthesized
aaaaggaagcccaggaaag

SEQ ID NO: 1646 - RNA, 19 nt, artificial
  Chemically synthesized
ccauuuuucagaacuaucc

SEQ ID NO: 1647 - RNA, 19 nt, artificial
  Chemically synthesized
gaaaaauucagccugugag

SEQ ID NO: 1648 - RNA, 19 nt, artificial
  Chemically synthesized
uugagauugaugcuucaga

SEQ ID NO: 1649 - RNA, 19 nt, artificial
  Chemically synthesized
gaguuugaugacuguaccc

SEQ ID NO: 1650 - RNA, 19 nt, artificial
  Chemically synthesized
aacuuugugaagagugagu

SEQ ID NO: 1651 - RNA, 19 nt, artificial
  Chemically synthesized
uggaauuaacacaauagag

SEQ ID NO: 1652 - RNA, 19 nt, artificial
  Chemically synthesized
cagugagcgggaugccuac

SEQ ID NO: 1653 - RNA, 19 nt, artificial
  Chemically synthesized
acaguguaacaggcugcau

SEQ ID NO: 1654 - RNA, 19 nt, artificial
  Chemically synthesized
acaggcugcauucccaaga

SEQ ID NO: 1655 - RNA, 19 nt, artificial
  Chemically synthesized
ccuggcccucucuacaaac

SEQ ID NO: 1656 - RNA, 19 nt, artificial
  Chemically synthesized
ggucaucaucagccucucc

SEQ ID NO: 1657 - RNA, 19 nt, artificial
  Chemically synthesized
agcagcauauuuuacugcu

SEQ ID NO: 1658 - RNA, 19 nt, artificial
  Chemically synthesized
uuagaguuugaugacugua

SEQ ID NO: 1659 - RNA, 19 nt, artificial
  Chemically synthesized
caaguaugaacuggacuuc

SEQ ID NO: 1660 - RNA, 19 nt, artificial
  Chemically synthesized
aucaccuacauuagcaaca

SEQ ID NO: 1661 - RNA, 19 nt, artificial
  Chemically synthesized
guaaaucugagagcugcga

SEQ ID NO: 1662 - RNA, 19 nt, artificial
  Chemically synthesized
aaucacaguagaaaacagu

SEQ ID NO: 1663 - RNA, 19 nt, artificial
  Chemically synthesized
uucauuccuggcaagugga

SEQ ID NO: 1664 - RNA, 19 nt, artificial
  Chemically synthesized
uuugaugagaacaaugaug

SEQ ID NO: 1665 - RNA, 19 nt, artificial
  Chemically synthesized
gcuggagaacuucaauccc

SEQ ID NO: 1666 - RNA, 19 nt, artificial
  Chemically synthesized
agcgggacuucauuccugg

SEQ ID NO: 1667 - RNA, 19 nt, artificial
  Chemically synthesized
uaugagccaaaaaguuuga

SEQ ID NO: 1668 - RNA, 19 nt, artificial
  Chemically synthesized
gaaaacuuugugaagagug

SEQ ID NO: 1669 - RNA, 19 nt, artificial
  Chemically synthesized
gugucuucauaagcgggac

SEQ ID NO: 1670 - RNA, 19 nt, artificial
  Chemically synthesized
cucuccaaggaagaauccu

SEQ ID NO: 1671 - RNA, 19 nt, artificial
  Chemically synthesized
uaacaggcugcauucccaa

SEQ ID NO: 1672 - RNA, 19 nt, artificial
  Chemically synthesized
gggaugccuacugggugga

SEQ ID NO: 1673 - RNA, 19 nt, artificial
  Chemically synthesized
gauaaugaacaccaagacc

SEQ ID NO: 1674 - RNA, 19 nt, artificial
  Chemically synthesized
guaagucaucugauccuuc

SEQ ID NO: 1675 - RNA, 19 nt, artificial
  Chemically synthesized
guuccguggaauguuugga

SEQ ID NO: 1676 - RNA, 19 nt, artificial
  Chemically synthesized
ugcaagggcagcucaggau

SEQ ID NO: 1677 - RNA, 19 nt, artificial
  Chemically synthesized
ugaacuggacuucucccau

SEQ ID NO: 1678 - RNA, 19 nt, artificial
  Chemically synthesized
cauuugcuccugugaauuc

SEQ ID NO: 1679 - RNA, 19 nt, artificial
  Chemically synthesized
cuucacucaggagcagcaa

SEQ ID NO: 1680 - RNA, 19 nt, artificial
  Chemically synthesized
uccuggcaaguggaucauu

SEQ ID NO: 1681 - RNA, 19 nt, artificial
  Chemically synthesized
aucagauuucuggauuguu

SEQ ID NO: 1682 - RNA, 19 nt, artificial
  Chemically synthesized
uccauugaaaagagccaca

SEQ ID NO: 1683 - RNA, 19 nt, artificial
  Chemically synthesized
auugauuggccagcaaauu

SEQ ID NO: 1684 - RNA, 19 nt, artificial
  Chemically synthesized
ucaggaucuuuaaacucca

SEQ ID NO: 1685 - RNA, 19 nt, artificial
  Chemically synthesized
aacugucuuugugcuuucu

SEQ ID NO: 1686 - RNA, 19 nt, artificial
  Chemically synthesized
cuggugcugacauccaaug

SEQ ID NO: 1687 - RNA, 19 nt, artificial
  Chemically synthesized
caagcacuggccaaagucu

SEQ ID NO: 1688 - RNA, 19 nt, artificial
  Chemically synthesized
uccaaggaagaauccucca

SEQ ID NO: 1689 - RNA, 19 nt, artificial
  Chemically synthesized
uucagaauguaagucaucu

SEQ ID NO: 1690 - RNA, 19 nt, artificial
  Chemically synthesized
uauuuuacugcuggagauu

SEQ ID NO: 1691 - RNA, 19 nt, artificial
  Chemically synthesized
ucugauccuucauaugaag

SEQ ID NO: 1692 - RNA, 19 nt, artificial
  Chemically synthesized
cgaauacacaguguaacag

SEQ ID NO: 1693 - RNA, 19 nt, artificial
  Chemically synthesized
ggcucuggugcugacaucc

SEQ ID NO: 1694 - RNA, 19 nt, artificial
  Chemically synthesized
cacauacuuuguggauggu

SEQ ID NO: 1695 - RNA, 19 nt, artificial
  Chemically synthesized
gaugccucccucuuaccca

SEQ ID NO: 1696 - RNA, 19 nt, artificial
  Chemically synthesized
ccuugaccuguccaacaac

SEQ ID NO: 1697 - RNA, 19 nt, artificial
  Chemically synthesized
aaacuuacugggaaauccu

SEQ ID NO: 1698 - RNA, 19 nt, artificial
  Chemically synthesized
cuuccuugaggaacuugag

SEQ ID NO: 1699 - RNA, 19 nt, artificial
  Chemically synthesized
caaauuaccugugugacuc

SEQ ID NO: 1700 - RNA, 19 nt, artificial
  Chemically synthesized
acagugaccuacagaggug

SEQ ID NO: 1701 - RNA, 19 nt, artificial
  Chemically synthesized
gaaaagauuuugcuggacu

SEQ ID NO: 1702 - RNA, 19 nt, artificial
  Chemically synthesized
aaguaugaacuggacuucu

SEQ ID NO: 1703 - RNA, 19 nt, artificial
  Chemically synthesized
uugauuggccagcaaauua

SEQ ID NO: 1704 - RNA, 19 nt, artificial
  Chemically synthesized
gacucuaccagaugccucc

SEQ ID NO: 1705 - RNA, 19 nt, artificial
  Chemically synthesized
cuuacugggaaauccuuac

SEQ ID NO: 1706 - RNA, 19 nt, artificial
  Chemically synthesized
acuucucccauuuccgucu

SEQ ID NO: 1707 - RNA, 19 nt, artificial
  Chemically synthesized
ccagcacacgaauacacag

SEQ ID NO: 1708 - RNA, 19 nt, artificial
  Chemically synthesized
uucucaucucacaaaauug

SEQ ID NO: 1709 - RNA, 19 nt, artificial
  Chemically synthesized
cauaagcgggacuucauuc

SEQ ID NO: 1710 - RNA, 19 nt, artificial
  Chemically synthesized
aaucaggcuucucugucuu

SEQ ID NO: 1711 - RNA, 19 nt, artificial
  Chemically synthesized
cugcauucccaagacacug

SEQ ID NO: 1712 - RNA, 19 nt, artificial
  Chemically synthesized
uuccguggaauguuuggaa

SEQ ID NO: 1713 - RNA, 19 nt, artificial
  Chemically synthesized
acuugaaaaauucagccug

SEQ ID NO: 1714 - RNA, 19 nt, artificial
  Chemically synthesized
acaauagaggaagauucuu

SEQ ID NO: 1715 - RNA, 19 nt, artificial
  Chemically synthesized
uagaguuugaugacuguac

SEQ ID NO: 1716 - RNA, 19 nt, artificial
  Chemically synthesized
gugucuggcaugugcugug

SEQ ID NO: 1717 - RNA, 19 nt, artificial
  Chemically synthesized
cuaaggagcaacuugacuc

SEQ ID NO: 1718 - RNA, 19 nt, artificial
  Chemically synthesized
cuuugugaagagugagugg

SEQ ID NO: 1719 - RNA, 19 nt, artificial
  Chemically synthesized
aggccaaaaggaagcccag

SEQ ID NO: 1720 - RNA, 19 nt, artificial
  Chemically synthesized
aaauauggacaccuucacu

SEQ ID NO: 1721 - RNA, 19 nt, artificial
  Chemically synthesized
acuuaccuuccuugaggaa

SEQ ID NO: 1722 - RNA, 19 nt, artificial
  Chemically synthesized
agacuuuggaagcuggugg

SEQ ID NO: 1723 - RNA, 19 nt, artificial
  Chemically synthesized
gauuuugcuggacuuaccu

SEQ ID NO: 1724 - RNA, 19 nt, artificial
  Chemically synthesized
gaugacuguacccuuaaug

SEQ ID NO: 1725 - RNA, 19 nt, artificial
  Chemically synthesized
cucuccaucccaugugcgu

SEQ ID NO: 1726 - RNA, 19 nt, artificial
  Chemically synthesized
acagcacuggugucuggca

SEQ ID NO: 1727 - RNA, 19 nt, artificial
  Chemically synthesized
cuaccagaugccucccucu

SEQ ID NO: 1728 - RNA, 19 nt, artificial
  Chemically synthesized
ugcaaguaugaacuggacu

SEQ ID NO: 1729 - RNA, 19 nt, artificial
  Chemically synthesized
aaacugucuuugugcuuuc

SEQ ID NO: 1730 - RNA, 19 nt, artificial
  Chemically synthesized
caucaucagccucuccaag

SEQ ID NO: 1731 - RNA, 19 nt, artificial
  Chemically synthesized
augagaacaaugaugcugc

SEQ ID NO: 1732 - RNA, 19 nt, artificial
  Chemically synthesized
uacugggaaauccuuacaa

SEQ ID NO: 1733 - RNA, 19 nt, artificial
  Chemically synthesized
gauucuuuuucuucccugg

SEQ ID NO: 1734 - RNA, 19 nt, artificial
  Chemically synthesized
ggccaaaaggaagcccagg

SEQ ID NO: 1735 - RNA, 19 nt, artificial
  Chemically synthesized
auguaagucaucugauccu

SEQ ID NO: 1736 - RNA, 19 nt, artificial
  Chemically synthesized
gugacucuccaucccaugu

SEQ ID NO: 1737 - RNA, 19 nt, artificial
  Chemically synthesized
aucagccucuccaaggaag

SEQ ID NO: 1738 - RNA, 19 nt, artificial
  Chemically synthesized
acaggaucaccuacauuag

SEQ ID NO: 1739 - RNA, 19 nt, artificial
  Chemically synthesized
uuggaagcugguggcaaua

SEQ ID NO: 1740 - RNA, 19 nt, artificial
  Chemically synthesized
agaccuaccuggaguggcc

SEQ ID NO: 1741 - RNA, 19 nt, artificial
  Chemically synthesized
gauaaugacagaguuauag

SEQ ID NO: 1742 - RNA, 19 nt, artificial
  Chemically synthesized
guggugcaaguaugaacug

SEQ ID NO: 1743 - RNA, 19 nt, artificial
  Chemically synthesized
uuuacugcuggagauuuuu

SEQ ID NO: 1744 - RNA, 19 nt, artificial
  Chemically synthesized
gaagagugaguggugcaag

SEQ ID NO: 1745 - RNA, 19 nt, artificial
  Chemically synthesized
ucuggauuguuagaauuag

SEQ ID NO: 1746 - RNA, 19 nt, artificial
  Chemically synthesized
guaugaacuggacuucucc

SEQ ID NO: 1747 - RNA, 19 nt, artificial
  Chemically synthesized
acaguagaaaacaguaaag

SEQ ID NO: 1748 - RNA, 19 nt, artificial
  Chemically synthesized
gacucuccaucccaugugc

SEQ ID NO: 1749 - RNA, 19 nt, artificial
  Chemically synthesized
uugaauuugccgcaacuca

SEQ ID NO: 1750 - RNA, 19 nt, artificial
  Chemically synthesized
ucagaacuauccacuggug

SEQ ID NO: 1751 - RNA, 19 nt, artificial
  Chemically synthesized
cuccaaggaagaauccucc

SEQ ID NO: 1752 - RNA, 19 nt, artificial
  Chemically synthesized
accuguccaacaacaggau

SEQ ID NO: 1753 - RNA, 19 nt, artificial
  Chemically synthesized
caccaagaccuaccuggag

SEQ ID NO: 1754 - RNA, 19 nt, artificial
  Chemically synthesized
auuuuggguaaaucugaga

SEQ ID NO: 1755 - RNA, 19 nt, artificial
  Chemically synthesized
aauccggaggcugcauauu

SEQ ID NO: 1756 - RNA, 19 nt, artificial
  Chemically synthesized
guugugucuucauaagcgg

SEQ ID NO: 1757 - RNA, 19 nt, artificial
  Chemically synthesized
guggaauguuuggaacugc

SEQ ID NO: 1758 - RNA, 19 nt, artificial
  Chemically synthesized
aaauuaccugugugacucu

SEQ ID NO: 1759 - RNA, 19 nt, artificial
  Chemically synthesized
gaucuacagagcuaugagc

SEQ ID NO: 1760 - RNA, 19 nt, artificial
  Chemically synthesized
uccaaucaggcuucucugu

SEQ ID NO: 1761 - RNA, 19 nt, artificial
  Chemically synthesized
acaaugaugcugccauucu

SEQ ID NO: 1762 - RNA, 19 nt, artificial
  Chemically synthesized
agcacacgaauacacagug

SEQ ID NO: 1763 - RNA, 19 nt, artificial
  Chemically synthesized
acauuagcaacagugaccu

SEQ ID NO: 1764 - RNA, 19 nt, artificial
  Chemically synthesized
agaauccuccaaucaggcu

SEQ ID NO: 1765 - RNA, 19 nt, artificial
  Chemically synthesized
agcaagcacuggccaaagu

SEQ ID NO: 1766 - RNA, 19 nt, artificial
  Chemically synthesized
uauccagcacacgaauaca

SEQ ID NO: 1767 - RNA, 19 nt, artificial
  Chemically synthesized
aggaucuuuaaacuccauu

SEQ ID NO: 1768 - RNA, 19 nt, artificial
  Chemically synthesized
auugaugcuucagaucuac

SEQ ID NO: 1769 - RNA, 19 nt, artificial
  Chemically synthesized
accuacauuagcaacagug

SEQ ID NO: 1770 - RNA, 19 nt, artificial
  Chemically synthesized
ugaugcuucagaucuacag

SEQ ID NO: 1771 - RNA, 19 nt, artificial
  Chemically synthesized
uaccuuccuugaggaacuu

SEQ ID NO: 1772 - RNA, 19 nt, artificial
  Chemically synthesized
caaagaaaagauuuugcug

SEQ ID NO: 1773 - RNA, 19 nt, artificial
  Chemically synthesized
gcggaagauaaugaacacc

SEQ ID NO: 1774 - RNA, 19 nt, artificial
  Chemically synthesized
aaguuuuucugguuccuug

SEQ ID NO: 1775 - RNA, 19 nt, artificial
  Chemically synthesized
uugaugcuucagaucuaca

SEQ ID NO: 1776 - RNA, 19 nt, artificial
  Chemically synthesized
agaguuaaaagaaucacag

SEQ ID NO: 1777 - RNA, 19 nt, artificial
  Chemically synthesized
cccagcgcuucugcaagcu

SEQ ID NO: 1778 - RNA, 19 nt, artificial
  Chemically synthesized
gcaagggcagcucaggauc

SEQ ID NO: 1779 - RNA, 19 nt, artificial
  Chemically synthesized
uugugcuuucugaaaacuu

SEQ ID NO: 1780 - RNA, 19 nt, artificial
  Chemically synthesized
ugugcugugcucuguuccu

SEQ ID NO: 1781 - RNA, 19 nt, artificial
  Chemically synthesized
uacacaguguaacaggcug

SEQ ID NO: 1782 - RNA, 19 nt, artificial
  Chemically synthesized
aguuugaugacuguacccu

SEQ ID NO: 1783 - RNA, 19 nt, artificial
  Chemically synthesized
uccagcacacgaauacaca

SEQ ID NO: 1784 - RNA, 19 nt, artificial
  Chemically synthesized
uggccagcaaauuaccugu

SEQ ID NO: 1785 - RNA, 19 nt, artificial
  Chemically synthesized
aaaugugaaaaucaccgau

SEQ ID NO: 1786 - RNA, 19 nt, artificial
  Chemically synthesized
aacaacaggaucaccuaca

SEQ ID NO: 1787 - RNA, 19 nt, artificial
  Chemically synthesized
cucuuacccauguuacuag

SEQ ID NO: 1788 - RNA, 19 nt, artificial
  Chemically synthesized
ugguuccuuguuuacuuuc

SEQ ID NO: 1789 - RNA, 19 nt, artificial
  Chemically synthesized
ugagaaaaaagccauuccc

SEQ ID NO: 1790 - RNA, 19 nt, artificial
  Chemically synthesized
caacagugaccuacagagg

SEQ ID NO: 1791 - RNA, 19 nt, artificial
  Chemically synthesized
auaaguugaugacucuacc

SEQ ID NO: 1792 - RNA, 19 nt, artificial
  Chemically synthesized
uucuuacagugagcgggau

SEQ ID NO: 1793 - RNA, 19 nt, artificial
  Chemically synthesized
gaucaccuacauuagcaac

SEQ ID NO: 1794 - RNA, 19 nt, artificial
  Chemically synthesized
cacaaaacugucuuugugc

SEQ ID NO: 1795 - RNA, 19 nt, artificial
  Chemically synthesized
cuugaggaacuugagauug

SEQ ID NO: 1796 - RNA, 19 nt, artificial
  Chemically synthesized
ucuccaaggaagaauccuc

SEQ ID NO: 1797 - RNA, 19 nt, artificial
  Chemically synthesized
aaauucagccugugaggau

SEQ ID NO: 1798 - RNA, 19 nt, artificial
  Chemically synthesized
ugagaacaaugaugcugcc

SEQ ID NO: 1799 - RNA, 19 nt, artificial
  Chemically synthesized
ucugagagcugcgauaaag

SEQ ID NO: 1800 - RNA, 19 nt, artificial
  Chemically synthesized
caucucuuuuuucucaucu

SEQ ID NO: 1801 - RNA, 19 nt, artificial
  Chemically synthesized
gaaauauggacaccuucac

SEQ ID NO: 1802 - RNA, 19 nt, artificial
  Chemically synthesized
cuuuaaacuccauucccuc

SEQ ID NO: 1803 - RNA, 19 nt, artificial
  Chemically synthesized
uucuuugaauuugccgcaa

SEQ ID NO: 1804 - RNA, 19 nt, artificial
  Chemically synthesized
uucuucuggagcccauuga

SEQ ID NO: 1805 - RNA, 19 nt, artificial
  Chemically synthesized
uggguaaaucugagagcug

SEQ ID NO: 1806 - RNA, 19 nt, artificial
  Chemically synthesized
ccacuggugaaacaaauuc

SEQ ID NO: 1807 - RNA, 19 nt, artificial
  Chemically synthesized
cgggaugccuacugggugg

SEQ ID NO: 1808 - RNA, 19 nt, artificial
  Chemically synthesized
cuggagauuuuuguagaug

SEQ ID NO: 1809 - RNA, 19 nt, artificial
  Chemically synthesized
ugaagcagcauauuuuacu

SEQ ID NO: 1810 - RNA, 19 nt, artificial
  Chemically synthesized
auuugccgcaacucaaaga

SEQ ID NO: 1811 - RNA, 19 nt, artificial
  Chemically synthesized
gaaccuuaugguccaggag

SEQ ID NO: 1812 - RNA, 19 nt, artificial
  Chemically synthesized
augaacuggacuucuccca

SEQ ID NO: 1813 - RNA, 19 nt, artificial
  Chemically synthesized
uucucccauuuccgucuuu

SEQ ID NO: 1814 - RNA, 19 nt, artificial
  Chemically synthesized
aacagugaccuacagaggu

SEQ ID NO: 1815 - RNA, 19 nt, artificial
  Chemically synthesized
uucagaacuauccacuggu

SEQ ID NO: 1816 - RNA, 19 nt, artificial
  Chemically synthesized
aauaaguugaugacucuac

SEQ ID NO: 1817 - RNA, 19 nt, artificial
  Chemically synthesized
gucuggcaugugcugugcu

SEQ ID NO: 1818 - RNA, 19 nt, artificial
  Chemically synthesized
ugcuucagaucuacagagc

SEQ ID NO: 1819 - RNA, 19 nt, artificial
  Chemically synthesized
ucauuccuggcaaguggau

SEQ ID NO: 1820 - RNA, 19 nt, artificial
  Chemically synthesized
aagggcagcucaggaucuu

SEQ ID NO: 1821 - RNA, 19 nt, artificial
  Chemically synthesized
cuaugccugaaacuuguca

SEQ ID NO: 1822 - RNA, 19 nt, artificial
  Chemically synthesized
ucagaauguaagucaucug

SEQ ID NO: 1823 - RNA, 19 nt, artificial
  Chemically synthesized
gaucuuuaaacuccauucc

SEQ ID NO: 1824 - RNA, 19 nt, artificial
  Chemically synthesized
uccggaggcugcauauucc

SEQ ID NO: 1825 - RNA, 19 nt, artificial
  Chemically synthesized
aauacacaguguaacaggc

SEQ ID NO: 1826 - RNA, 19 nt, artificial
  Chemically synthesized
augccuggcccucucuaca

SEQ ID NO: 1827 - RNA, 19 nt, artificial
  Chemically synthesized
ucagaucuacagagcuaug

SEQ ID NO: 1828 - RNA, 19 nt, artificial
  Chemically synthesized
uuugccgcaacucaaagaa

SEQ ID NO: 1829 - RNA, 19 nt, artificial
  Chemically synthesized
uggacuuaccuuccuugag

SEQ ID NO: 1830 - RNA, 19 nt, artificial
  Chemically synthesized
accuggaguggcccaugga

SEQ ID NO: 1831 - RNA, 19 nt, artificial
  Chemically synthesized
auacacaguguaacaggcu

SEQ ID NO: 1832 - RNA, 19 nt, artificial
  Chemically synthesized
acuucauuccuggcaagug

SEQ ID NO: 1833 - RNA, 19 nt, artificial
  Chemically synthesized
auucuuaaacuuacuggga

SEQ ID NO: 1834 - RNA, 19 nt, artificial
  Chemically synthesized
ugagccaaaaaguuugaag

SEQ ID NO: 1835 - RNA, 19 nt, artificial
  Chemically synthesized
gcuuucugaaaacuuugug

SEQ ID NO: 1836 - RNA, 19 nt, artificial
  Chemically synthesized
gcgggacuucauuccuggc

SEQ ID NO: 1837 - RNA, 19 nt, artificial
  Chemically synthesized
acaucucuuuuuucucauc

SEQ ID NO: 1838 - RNA, 19 nt, artificial
  Chemically synthesized
uuuuucugguuccuuguuu

SEQ ID NO: 1839 - RNA, 19 nt, artificial
  Chemically synthesized
ggaagcccaggaaagcucc

SEQ ID NO: 1840 - RNA, 19 nt, artificial
  Chemically synthesized
uaccugugugacucuccau

SEQ ID NO: 1841 - RNA, 19 nt, artificial
  Chemically synthesized
acaguaaaguuuuucuggu

SEQ ID NO: 1842 - RNA, 19 nt, artificial
  Chemically synthesized
augagccaaaaaguuugaa

SEQ ID NO: 1843 - RNA, 19 nt, artificial
  Chemically synthesized
ugaacauuuagacuuaucc

SEQ ID NO: 1844 - RNA, 19 nt, artificial
  Chemically synthesized
uugaaaagagccacaaaac

SEQ ID NO: 1845 - RNA, 19 nt, artificial
  Chemically synthesized
auucagaauguaagucauc

SEQ ID NO: 1846 - RNA, 19 nt, artificial
  Chemically synthesized
caucccaugugcguggcca

SEQ ID NO: 1847 - RNA, 19 nt, artificial
  Chemically synthesized
aagcugguggcaauaacuu

SEQ ID NO: 1848 - RNA, 19 nt, artificial
  Chemically synthesized
uggaauguuuggaacugcg

SEQ ID NO: 1849 - RNA, 19 nt, artificial
  Chemically synthesized
guucaggauguccgccucu

SEQ ID NO: 1850 - RNA, 19 nt, artificial
  Chemically synthesized
gacacuuuccauuuuucag

SEQ ID NO: 1851 - RNA, 19 nt, artificial
  Chemically synthesized
uccauuuuucagaacuauc

SEQ ID NO: 1852 - RNA, 19 nt, artificial
  Chemically synthesized
ucucccauuuccgucuuuu

SEQ ID NO: 1853 - RNA, 19 nt, artificial
  Chemically synthesized
cuugagauugaugcuucag

SEQ ID NO: 1854 - RNA, 19 nt, artificial
  Chemically synthesized
ugauuggccagcaaauuac

SEQ ID NO: 1855 - RNA, 19 nt, artificial
  Chemically synthesized
ucuuuuucuucccugggca

SEQ ID NO: 1856 - RNA, 19 nt, artificial
  Chemically synthesized
gaaauccuuacaaaacccu

SEQ ID NO: 1857 - RNA, 19 nt, artificial
  Chemically synthesized
ucaucugauccuucauaug

SEQ ID NO: 1858 - RNA, 19 nt, artificial
  Chemically synthesized
ugugugacucuccauccca

SEQ ID NO: 1859 - RNA, 19 nt, artificial
  Chemically synthesized
guuucuuacagugagcggg

SEQ ID NO: 1860 - RNA, 19 nt, artificial
  Chemically synthesized
ucuuacccauguuacuagu

SEQ ID NO: 1861 - RNA, 19 nt, artificial
  Chemically synthesized
uuccgucuuuuugaugaga

SEQ ID NO: 1862 - RNA, 19 nt, artificial
  Chemically synthesized
augacagaguuauagaucc

SEQ ID NO: 1863 - RNA, 19 nt, artificial
  Chemically synthesized
gcauauuuuacugcuggag

SEQ ID NO: 1864 - RNA, 19 nt, artificial
  Chemically synthesized
cuggacuucucccauuucc

SEQ ID NO: 1865 - RNA, 19 nt, artificial
  Chemically synthesized
aauucagccugugaggaug

SEQ ID NO: 1866 - RNA, 19 nt, artificial
  Chemically synthesized
auccggaggcugcauauuc

SEQ ID NO: 1867 - RNA, 19 nt, artificial
  Chemically synthesized
guggauggugugggucuug

SEQ ID NO: 1868 - RNA, 19 nt, artificial
  Chemically synthesized
ugucuucauaagcgggacu

SEQ ID NO: 1869 - RNA, 19 nt, artificial
  Chemically synthesized
ccuaccuggaguggcccau

SEQ ID NO: 1870 - RNA, 19 nt, artificial
  Chemically synthesized
uugaaaaucaguaggaaug

SEQ ID NO: 1871 - RNA, 19 nt, artificial
  Chemically synthesized
caacaacaggaucaccuac

SEQ ID NO: 1872 - RNA, 19 nt, artificial
  Chemically synthesized
agccacaaaacugucuuug

SEQ ID NO: 1873 - RNA, 19 nt, artificial
  Chemically synthesized
uugacaauaucauugacuc

SEQ ID NO: 1874 - RNA, 19 nt, artificial
  Chemically synthesized
accgaugaaaguuuguuuc

SEQ ID NO: 1875 - RNA, 19 nt, artificial
  Chemically synthesized
cacuggugucuggcaugug

SEQ ID NO: 1876 - RNA, 19 nt, artificial
  Chemically synthesized
cauuccuggcaaguggauc

SEQ ID NO: 1877 - RNA, 19 nt, artificial
  Chemically synthesized
uacugcuggagauuuuugu

SEQ ID NO: 1878 - RNA, 19 nt, artificial
  Chemically synthesized
ugccacauacuuuguggau

SEQ ID NO: 1879 - RNA, 19 nt, artificial
  Chemically synthesized
cucuuuuuucucaucucac

SEQ ID NO: 1880 - RNA, 19 nt, artificial
  Chemically synthesized
ccucuccaaggaagaaucc

SEQ ID NO: 1881 - RNA, 19 nt, artificial
  Chemically synthesized
uucugcaagcugcggaaga

SEQ ID NO: 1882 - RNA, 19 nt, artificial
  Chemically synthesized
ucuaaggagcaacuugacu

SEQ ID NO: 1883 - RNA, 19 nt, artificial
  Chemically synthesized
cccaugugcguggccagca

SEQ ID NO: 1884 - RNA, 19 nt, artificial
  Chemically synthesized
ggccagcaaauuaccugug

SEQ ID NO: 1885 - RNA, 19 nt, artificial
  Chemically synthesized
ugugucuucauaagcggga

SEQ ID NO: 1886 - RNA, 19 nt, artificial
  Chemically synthesized
uuggguaaaucugagagcu

SEQ ID NO: 1887 - RNA, 19 nt, artificial
  Chemically synthesized
agcaaauuaccugugugac

SEQ ID NO: 1888 - RNA, 19 nt, artificial
  Chemically synthesized
uuucuuacagugagcggga

SEQ ID NO: 1889 - RNA, 19 nt, artificial
  Chemically synthesized
gacuucucccauuuccguc

SEQ ID NO: 1890 - RNA, 19 nt, artificial
  Chemically synthesized
aaggaagcccaggaaagcu

SEQ ID NO: 1891 - RNA, 19 nt, artificial
  Chemically synthesized
guacccuuaauggaguugg

SEQ ID NO: 1892 - RNA, 19 nt, artificial
  Chemically synthesized
agaaaugugaaaaucaccg

SEQ ID NO: 1893 - RNA, 19 nt, artificial
  Chemically synthesized
gaagauucuuuuucuuccc

SEQ ID NO: 1894 - RNA, 19 nt, artificial
  Chemically synthesized
cuccauugaaaagagccac

SEQ ID NO: 1895 - RNA, 19 nt, artificial
  Chemically synthesized
cauucuuaaacuuacuggg

SEQ ID NO: 1896 - RNA, 19 nt, artificial
  Chemically synthesized
augcuucagaucuacagag

SEQ ID NO: 1897 - RNA, 19 nt, artificial
  Chemically synthesized
uauggacaccuucacuaag

SEQ ID NO: 1898 - RNA, 19 nt, artificial
  Chemically synthesized
uguuccugcugauccugcu

SEQ ID NO: 1899 - RNA, 19 nt, artificial
  Chemically synthesized
gcgggaugccuacugggug

SEQ ID NO: 1900 - RNA, 19 nt, artificial
  Chemically synthesized
auacuuuguggauggugug

SEQ ID NO: 1901 - RNA, 19 nt, artificial
  Chemically synthesized
auuuugcuggacuuaccuu

SEQ ID NO: 1902 - RNA, 19 nt, artificial
  Chemically synthesized
uuucuuugaauuugccgca

SEQ ID NO: 1903 - RNA, 19 nt, artificial
  Chemically synthesized
aggaacuugagauugaugc

SEQ ID NO: 1904 - RNA, 19 nt, artificial
  Chemically synthesized
aucucuuuuuucucaucuc

SEQ ID NO: 1905 - RNA, 19 nt, artificial
  Chemically synthesized
ugcauucccaagacacugg

SEQ ID NO: 1906 - RNA, 19 nt, artificial
  Chemically synthesized
cugcgagauacugauuugg

SEQ ID NO: 1907 - RNA, 19 nt, artificial
  Chemically synthesized
caauaacuucauuugcucc

SEQ ID NO: 1908 - RNA, 19 nt, artificial
  Chemically synthesized
augccacauacuuugugga

SEQ ID NO: 1909 - RNA, 19 nt, artificial
  Chemically synthesized
agcgggaugccuacugggu

SEQ ID NO: 1910 - RNA, 19 nt, artificial
  Chemically synthesized
uagcaacagugaccuacag

SEQ ID NO: 1911 - RNA, 19 nt, artificial
  Chemically synthesized
uuuguuucuuacagugagc

SEQ ID NO: 1912 - RNA, 19 nt, artificial
  Chemically synthesized
uucugaaaacuuugugaag

SEQ ID NO: 1913 - RNA, 19 nt, artificial
  Chemically synthesized
aaguuugaagucaauucag

SEQ ID NO: 1914 - RNA, 19 nt, artificial
  Chemically synthesized
uaacaauccggaggcugca

SEQ ID NO: 1915 - RNA, 19 nt, artificial
  Chemically synthesized
uccugugccaccguuucca

SEQ ID NO: 1916 - RNA, 19 nt, artificial
  Chemically synthesized
cugcuggagauuuuuguag

SEQ ID NO: 1917 - RNA, 19 nt, artificial
  Chemically synthesized
agguucaggauguccgccu

SEQ ID NO: 1918 - RNA, 19 nt, artificial
  Chemically synthesized
uuaugguccaggagcugga

SEQ ID NO: 1919 - RNA, 19 nt, artificial
  Chemically synthesized
gacagaguuauagauccag

SEQ ID NO: 1920 - RNA, 19 nt, artificial
  Chemically synthesized
gaugccuggcccucucuac

SEQ ID NO: 1921 - RNA, 19 nt, artificial
  Chemically synthesized
gugcugugcucuguuccug

SEQ ID NO: 1922 - RNA, 19 nt, artificial
  Chemically synthesized
uggacuucucccauuuccg

SEQ ID NO: 1923 - RNA, 19 nt, artificial
  Chemically synthesized
uggcuccaggccaaaagga

SEQ ID NO: 1924 - RNA, 19 nt, artificial
  Chemically synthesized
aucaccgaugaaaguuugu

SEQ ID NO: 1925 - RNA, 19 nt, artificial
  Chemically synthesized
uggauuguuagaauuagag

SEQ ID NO: 1926 - RNA, 19 nt, artificial
  Chemically synthesized
uggguggagaaccuuaugg

SEQ ID NO: 1927 - RNA, 19 nt, artificial
  Chemically synthesized
uucuaaggagcaacuugac

SEQ ID NO: 1928 - RNA, 19 nt, artificial
  Chemically synthesized
auugagaaaaaagccauuc

SEQ ID NO: 1929 - RNA, 19 nt, artificial
  Chemically synthesized
gacuuuggaagcugguggc

SEQ ID NO: 1930 - RNA, 19 nt, artificial
  Chemically synthesized
uuaccugugugacucucca

SEQ ID NO: 1931 - RNA, 19 nt, artificial
  Chemically synthesized
gaaacaucucuuuuuucuc

SEQ ID NO: 1932 - RNA, 19 nt, artificial
  Chemically synthesized
uuugaacuuauccagcaca

SEQ ID NO: 1933 - RNA, 19 nt, artificial
  Chemically synthesized
ugccuacuggguggagaac

SEQ ID NO: 1934 - RNA, 19 nt, artificial
  Chemically synthesized
auuugaacuuauccagcac

SEQ ID NO: 1935 - RNA, 19 nt, artificial
  Chemically synthesized
uuacaaguuccguggaaug

SEQ ID NO: 1936 - RNA, 19 nt, artificial
  Chemically synthesized
ucaggcuucucugucuugu

SEQ ID NO: 1937 - RNA, 19 nt, artificial
  Chemically synthesized
agcgcuucugcaagcugcg

SEQ ID NO: 1938 - RNA, 19 nt, artificial
  Chemically synthesized
uaacuucauuugcuccugu

SEQ ID NO: 1939 - RNA, 19 nt, artificial
  Chemically synthesized
aauccuccaaucaggcuuc

SEQ ID NO: 1940 - RNA, 19 nt, artificial
  Chemically synthesized
acacaguguaacaggcugc

SEQ ID NO: 1941 - RNA, 19 nt, artificial
  Chemically synthesized
gagagcugcgauaaagucc

SEQ ID NO: 1942 - RNA, 19 nt, artificial
  Chemically synthesized
auugacuccauugaaaaga

SEQ ID NO: 1943 - RNA, 19 nt, artificial
  Chemically synthesized
ccuuaugguccaggagcug

SEQ ID NO: 1944 - RNA, 19 nt, artificial
  Chemically synthesized
cagcgcuucugcaagcugc

SEQ ID NO: 1945 - RNA, 19 nt, artificial
  Chemically synthesized
acuggacuucucccauuuc

SEQ ID NO: 1946 - RNA, 19 nt, artificial
  Chemically synthesized
guguaacaggcugcauucc

SEQ ID NO: 1947 - RNA, 19 nt, artificial
  Chemically synthesized
uuugcuccugugaauuccu

SEQ ID NO: 1948 - RNA, 19 nt, artificial
  Chemically synthesized
aguuccguggaauguuugg

SEQ ID NO: 1949 - RNA, 19 nt, artificial
  Chemically synthesized
cagccugugaggaugccug

SEQ ID NO: 1950 - RNA, 19 nt, artificial
  Chemically synthesized
ucuucuggagcccauugag

SEQ ID NO: 1951 - RNA, 19 nt, artificial
  Chemically synthesized
uuguggauggugugggucu

SEQ ID NO: 1952 - RNA, 19 nt, artificial
  Chemically synthesized
aaaaauucagccugugagg

SEQ ID NO: 1953 - RNA, 19 nt, artificial
  Chemically synthesized
uggcaauaacuucauuugc

SEQ ID NO: 1954 - RNA, 19 nt, artificial
  Chemically synthesized
uggugucuggcaugugcug

SEQ ID NO: 1955 - RNA, 19 nt, artificial
  Chemically synthesized
cagcauauuuuacugcugg

SEQ ID NO: 1956 - RNA, 19 nt, artificial
  Chemically synthesized
uugucaguggccagaaaag

SEQ ID NO: 1957 - RNA, 19 nt, artificial
  Chemically synthesized
uuuaaacuccauucccuca

SEQ ID NO: 1958 - RNA, 19 nt, artificial
  Chemically synthesized
ccugugugacucuccaucc

SEQ ID NO: 1959 - RNA, 19 nt, artificial
  Chemically synthesized
gagcagcaagcacuggcca

SEQ ID NO: 1960 - RNA, 19 nt, artificial
  Chemically synthesized
aggaagcccaggaaagcuc

SEQ ID NO: 1961 - RNA, 19 nt, artificial
  Chemically synthesized
gacuccauugaaaagagcc

SEQ ID NO: 1962 - RNA, 19 nt, artificial
  Chemically synthesized
uuccuugaggaacuugaga

SEQ ID NO: 1963 - RNA, 19 nt, artificial
  Chemically synthesized
uacaaguuccguggaaugu

SEQ ID NO: 1964 - RNA, 19 nt, artificial
  Chemically synthesized
aaaaucaccgaugaaaguu

SEQ ID NO: 1965 - RNA, 19 nt, artificial
  Chemically synthesized
ugacaauaucauugacucc

SEQ ID NO: 1966 - RNA, 19 nt, artificial
  Chemically synthesized
gaacaccaagaccuaccug

SEQ ID NO: 1967 - RNA, 19 nt, artificial
  Chemically synthesized
ucuuugaauuugccgcaac

SEQ ID NO: 1968 - RNA, 19 nt, artificial
  Chemically synthesized
ucaccgaugaaaguuuguu

SEQ ID NO: 1969 - RNA, 19 nt, artificial
  Chemically synthesized
ugagagcugcgauaaaguc

SEQ ID NO: 1970 - RNA, 19 nt, artificial
  Chemically synthesized
uggcaugugcugugcucug

SEQ ID NO: 1971 - RNA, 19 nt, artificial
  Chemically synthesized
acuggugucuggcaugugc

SEQ ID NO: 1972 - RNA, 19 nt, artificial
  Chemically synthesized
ucuucauaagcgggacuuc

SEQ ID NO: 1973 - RNA, 19 nt, artificial
  Chemically synthesized
auucuucuggagcccauug

SEQ ID NO: 1974 - RNA, 19 nt, artificial
  Chemically synthesized
aaaauucagccugugagga

SEQ ID NO: 1975 - RNA, 19 nt, artificial
  Chemically synthesized
ucaccuacauuagcaacag

SEQ ID NO: 1976 - RNA, 19 nt, artificial
  Chemically synthesized
ccuggaguggcccauggac

SEQ ID NO: 1977 - RNA, 19 nt, artificial
  Chemically synthesized
uccguggaauguuuggaac

SEQ ID NO: 1978 - RNA, 19 nt, artificial
  Chemically synthesized
accuaccuggaguggccca

SEQ ID NO: 1979 - RNA, 19 nt, artificial
  Chemically synthesized
uuuucuaaggagcaacuug

SEQ ID NO: 1980 - RNA, 19 nt, artificial
  Chemically synthesized
aaacuuugugaagagugag

SEQ ID NO: 1981 - RNA, 19 nt, artificial
  Chemically synthesized
auccuccaaucaggcuucu

SEQ ID NO: 1982 - RNA, 19 nt, artificial
  Chemically synthesized
uacuugaaaaauucagccu

SEQ ID NO: 1983 - RNA, 19 nt, artificial
  Chemically synthesized
uggugcaaguaugaacugg

SEQ ID NO: 1984 - RNA, 19 nt, artificial
  Chemically synthesized
aagcgggacuucauuccug

SEQ ID NO: 1985 - RNA, 19 nt, artificial
  Chemically synthesized
uagaaaugugaaaaucacc

SEQ ID NO: 1986 - RNA, 19 nt, artificial
  Chemically synthesized
uugaagucaauucagaaug

SEQ ID NO: 1987 - RNA, 19 nt, artificial
  Chemically synthesized
ucugaaaaacuugacuaac

SEQ ID NO: 1988 - RNA, 19 nt, artificial
  Chemically synthesized
aaugaacaccaagaccuac

SEQ ID NO: 1989 - RNA, 19 nt, artificial
  Chemically synthesized
gauuggccagcaaauuacc

SEQ ID NO: 1990 - RNA, 19 nt, artificial
  Chemically synthesized
acuuuccauuuuucagaac

SEQ ID NO: 1991 - RNA, 19 nt, artificial
  Chemically synthesized
acagaguuauagauccagg

SEQ ID NO: 1992 - RNA, 19 nt, artificial
  Chemically synthesized
ccaaucaggcuucucuguc

SEQ ID NO: 1993 - RNA, 19 nt, artificial
  Chemically synthesized
augguccaggagcuggaga

SEQ ID NO: 1994 - RNA, 19 nt, artificial
  Chemically synthesized
uucugguuccuuguuuacu

SEQ ID NO: 1995 - RNA, 19 nt, artificial
  Chemically synthesized
uggcaaguggaucauugac

SEQ ID NO: 1996 - RNA, 19 nt, artificial
  Chemically synthesized
auuagaauacuuggaucuc

SEQ ID NO: 1997 - RNA, 19 nt, artificial
  Chemically synthesized
cuuacagugagcgggaugc

SEQ ID NO: 1998 - RNA, 19 nt, artificial
  Chemically synthesized
uugugaagagugaguggug

SEQ ID NO: 1999 - RNA, 19 nt, artificial
  Chemically synthesized
aagagccacaaaacugucu

SEQ ID NO: 2000 - RNA, 19 nt, artificial
  Chemically synthesized
cuggcuccaggccaaaagg

SEQ ID NO: 2001 - RNA, 19 nt, artificial
  Chemically synthesized
cuccuucacucaggagcag

SEQ ID NO: 2002 - RNA, 19 nt, artificial
  Chemically synthesized
uugaugagaacaaugaugc

SEQ ID NO: 2003 - RNA, 19 nt, artificial
  Chemically synthesized
gcucuguuccugcugaucc

SEQ ID NO: 2004 - RNA, 19 nt, artificial
  Chemically synthesized
ugaugugggccuggcucca

SEQ ID NO: 2005 - RNA, 19 nt, artificial
  Chemically synthesized
ccuggcuccaggccaaaag

SEQ ID NO: 2006 - RNA, 19 nt, artificial
  Chemically synthesized
gaugacucuaccagaugcc

SEQ ID NO: 2007 - RNA, 19 nt, artificial
  Chemically synthesized
acuuugugaagagugagug

SEQ ID NO: 2008 - RNA, 19 nt, artificial
  Chemically synthesized
aagacacuggaaauuuuag

SEQ ID NO: 2009 - RNA, 19 nt, artificial
  Chemically synthesized
guccugugccaccguuucc

SEQ ID NO: 2010 - RNA, 19 nt, artificial
  Chemically synthesized
cagcucaggaucuuuaaac

SEQ ID NO: 2011 - RNA, 19 nt, artificial
  Chemically synthesized
auuugcuccugugaauucc

SEQ ID NO: 2012 - RNA, 19 nt, artificial
  Chemically synthesized
uuugugcuuucugaaaacu

SEQ ID NO: 2013 - RNA, 19 nt, artificial
  Chemically synthesized
aacaauccggaggcugcau

SEQ ID NO: 2014 - RNA, 19 nt, artificial
  Chemically synthesized
uaaaucugagagcugcgau

SEQ ID NO: 2015 - RNA, 19 nt, artificial
  Chemically synthesized
aucaucagccucuccaagg

SEQ ID NO: 2016 - RNA, 19 nt, artificial
  Chemically synthesized
uugagaaaaaagccauucc

SEQ ID NO: 2017 - RNA, 19 nt, artificial
  Chemically synthesized
agauucuuuuucuucccug

SEQ ID NO: 2018 - RNA, 19 nt, artificial
  Chemically synthesized
auaacuucauuugcuccug

SEQ ID NO: 2019 - RNA, 19 nt, artificial
  Chemically synthesized
cucuaccagaugccucccu

SEQ ID NO: 2020 - RNA, 19 nt, artificial
  Chemically synthesized
aagacuuuggaagcuggug

SEQ ID NO: 2021 - RNA, 19 nt, artificial
  Chemically synthesized
cucaggaucuuuaaacucc

SEQ ID NO: 2022 - RNA, 19 nt, artificial
  Chemically synthesized
acuuuggaagcugguggca

SEQ ID NO: 2023 - RNA, 19 nt, artificial
  Chemically synthesized
aaaggaagcccaggaaagc

SEQ ID NO: 2024 - RNA, 19 nt, artificial
  Chemically synthesized
aaguuccguggaauguuug

SEQ ID NO: 2025 - RNA, 19 nt, artificial
  Chemically synthesized
aaaguuuuucugguuccuu

SEQ ID NO: 2026 - RNA, 19 nt, artificial
  Chemically synthesized
ucccauuuccgucuuuuug

SEQ ID NO: 2027 - RNA, 19 nt, artificial
  Chemically synthesized
cagcaagcacuggccaaag

SEQ ID NO: 2028 - RNA, 19 nt, artificial
  Chemically synthesized
agugagcgggaugccuacu

SEQ ID NO: 2029 - RNA, 19 nt, artificial
  Chemically synthesized
aacuucauuugcuccugug

SEQ ID NO: 2030 - RNA, 19 nt, artificial
  Chemically synthesized
uugaugacucuaccagaug

SEQ ID NO: 2031 - RNA, 19 nt, artificial
  Chemically synthesized
ucuuacagugagcgggaug

SEQ ID NO: 2032 - RNA, 19 nt, artificial
  Chemically synthesized
cuuaccuuccuugaggaac

SEQ ID NO: 2033 - RNA, 19 nt, artificial
  Chemically synthesized
cuaccuggaguggcccaug

SEQ ID NO: 2034 - RNA, 19 nt, artificial
  Chemically synthesized
uuacugggaaauccuuaca

SEQ ID NO: 2035 - RNA, 19 nt, artificial
  Chemically synthesized
augacucuaccagaugccu

SEQ ID NO: 2036 - RNA, 19 nt, artificial
  Chemically synthesized
aucaggcuucucugucuug

SEQ ID NO: 2037 - RNA, 19 nt, artificial
  Chemically synthesized
uaagcgggacuucauuccu

SEQ ID NO: 2038 - RNA, 19 nt, artificial
  Chemically synthesized
ccagcgcuucugcaagcug

SEQ ID NO: 2039 - RNA, 19 nt, artificial
  Chemically synthesized
uacauuagcaacagugacc

SEQ ID NO: 2040 - RNA, 19 nt, artificial
  Chemically synthesized
aggaagauucuuuuucuuc

SEQ ID NO: 2041 - RNA, 19 nt, artificial
  Chemically synthesized
uugaaaaauucagccugug

SEQ ID NO: 2042 - RNA, 19 nt, artificial
  Chemically synthesized
ugugaagagugaguggugc

SEQ ID NO: 2043 - RNA, 19 nt, artificial
  Chemically synthesized
aacaggcugcauucccaag

SEQ ID NO: 2044 - RNA, 19 nt, artificial
  Chemically synthesized
aacuauccacuggugaaac

SEQ ID NO: 2045 - RNA, 19 nt, artificial
  Chemically synthesized
aagauuuugcuggacuuac

SEQ ID NO: 2046 - RNA, 19 nt, artificial
  Chemically synthesized
auccuucauaugaagcagc

SEQ ID NO: 2047 - RNA, 19 nt, artificial
  Chemically synthesized
cuucugcaagcugcggaag

SEQ ID NO: 2048 - RNA, 19 nt, artificial
  Chemically synthesized
cuccaggccaaaaggaagc

SEQ ID NO: 2049 - RNA, 19 nt, artificial
  Chemically synthesized
ugaacuuauccagcacacg

SEQ ID NO: 2050 - RNA, 19 nt, artificial
  Chemically synthesized
uaccagaugccucccucuu

SEQ ID NO: 2051 - RNA, 19 nt, artificial
  Chemically synthesized
aauaucauugacuccauug

SEQ ID NO: 2052 - RNA, 19 nt, artificial
  Chemically synthesized
ugacucuaccagaugccuc

SEQ ID NO: 2053 - RNA, 19 nt, artificial
  Chemically synthesized
aagccuugaccuguccaac

SEQ ID NO: 2054 - RNA, 19 nt, artificial
  Chemically synthesized
ggagcagcaagcacuggcc

SEQ ID NO: 2055 - RNA, 19 nt, artificial
  Chemically synthesized
cauuuccgucuuuuugaug

SEQ ID NO: 2056 - RNA, 19 nt, artificial
  Chemically synthesized
ucucaucucacaaaauugc

SEQ ID NO: 2057 - RNA, 19 nt, artificial
  Chemically synthesized
aacaccaagaccuaccugg

SEQ ID NO: 2058 - RNA, 19 nt, artificial
  Chemically synthesized
guaaaguuuuucugguucc

SEQ ID NO: 2059 - RNA, 19 nt, artificial
  Chemically synthesized
accugugugacucuccauc

SEQ ID NO: 2060 - RNA, 19 nt, artificial
  Chemically synthesized
cuccaucccaugugcgugg

SEQ ID NO: 2061 - RNA, 19 nt, artificial
  Chemically synthesized
augacuguacccuuaaugg

SEQ ID NO: 2062 - RNA, 19 nt, artificial
  Chemically synthesized
auuuuucagaacuauccac

SEQ ID NO: 2063 - RNA, 19 nt, artificial
  Chemically synthesized
gcucaggaucuuuaaacuc

SEQ ID NO: 2064 - RNA, 19 nt, artificial
  Chemically synthesized
aaguugugucuucauaagc

SEQ ID NO: 2065 - RNA, 19 nt, artificial
  Chemically synthesized
aaguugaugacucuaccag

SEQ ID NO: 2066 - RNA, 19 nt, artificial
  Chemically synthesized
uauagauccagguaaagug

SEQ ID NO: 2067 - RNA, 19 nt, artificial
  Chemically synthesized
agcccaggaaagcucccag

SEQ ID NO: 2068 - RNA, 19 nt, artificial
  Chemically synthesized
aaagagccacaaaacuguc

SEQ ID NO: 2069 - RNA, 19 nt, artificial
  Chemically synthesized
uguccaacaacaggaucac

SEQ ID NO: 2070 - RNA, 19 nt, artificial
  Chemically synthesized
augaacaccaagaccuacc

SEQ ID NO: 2071 - RNA, 19 nt, artificial
  Chemically synthesized
uugacuccauugaaaagag

SEQ ID NO: 2072 - RNA, 19 nt, artificial
  Chemically synthesized
agaaaagauuuugcuggac

SEQ ID NO: 2073 - RNA, 19 nt, artificial
  Chemically synthesized
ucuggcaugugcugugcuc

SEQ ID NO: 2074 - RNA, 19 nt, artificial
  Chemically synthesized
ugugacucuccaucccaug

SEQ ID NO: 2075 - RNA, 19 nt, artificial
  Chemically synthesized
cugugugacucuccauccc

SEQ ID NO: 2076 - RNA, 19 nt, artificial
  Chemically synthesized
caggaucaccuacauuagc

SEQ ID NO: 2077 - RNA, 19 nt, artificial
  Chemically synthesized
uguacccuuaauggaguug

SEQ ID NO: 2078 - RNA, 19 nt, artificial
  Chemically synthesized
uuccuggcaaguggaucau

SEQ ID NO: 2079 - RNA, 19 nt, artificial
  Chemically synthesized
gcaagcacuggccaaaguc

SEQ ID NO: 2080 - RNA, 19 nt, artificial
  Chemically synthesized
agccugugaggaugccugg

SEQ ID NO: 2081 - RNA, 19 nt, artificial
  Chemically synthesized
ugcucuguuccugcugauc

SEQ ID NO: 2082 - RNA, 19 nt, artificial
  Chemically synthesized
uugcuggacuuaccuuccu

SEQ ID NO: 2083 - RNA, 19 nt, artificial
  Chemically synthesized
uuaacaauccggaggcugc

SEQ ID NO: 2084 - RNA, 19 nt, artificial
  Chemically synthesized
uuucagaacuauccacugg

SEQ ID NO: 2085 - RNA, 19 nt, artificial
  Chemically synthesized
uuucugguuccuuguuuac

SEQ ID NO: 2086 - RNA, 19 nt, artificial
  Chemically synthesized
uuugugaagagugaguggu

SEQ ID NO: 2087 - RNA, 19 nt, artificial
  Chemically synthesized
ccuguccaacaacaggauc

SEQ ID NO: 2088 - RNA, 19 nt, artificial
  Chemically synthesized
uguuucuuacagugagcgg

SEQ ID NO: 2089 - RNA, 19 nt, artificial
  Chemically synthesized
augaagcagcauauuuuac

SEQ ID NO: 2090 - RNA, 19 nt, artificial
  Chemically synthesized
guccaacaacaggaucacc

SEQ ID NO: 2091 - RNA, 19 nt, artificial
  Chemically synthesized
uggugcugacauccaaugg

SEQ ID NO: 2092 - RNA, 19 nt, artificial
  Chemically synthesized
acugucuuugugcuuucug

SEQ ID NO: 2093 - RNA, 19 nt, artificial
  Chemically synthesized
aaaagccuugaccugucca

SEQ ID NO: 2094 - RNA, 19 nt, artificial
  Chemically synthesized
aauguaagucaucugaucc

SEQ ID NO: 2095 - RNA, 19 nt, artificial
  Chemically synthesized
cuuuuucuucccugggcag

SEQ ID NO: 2096 - RNA, 19 nt, artificial
  Chemically synthesized
uccaacaacaggaucaccu

SEQ ID NO: 2097 - RNA, 19 nt, artificial
  Chemically synthesized
auuagcaacagugaccuac

SEQ ID NO: 2098 - RNA, 19 nt, artificial
  Chemically synthesized
ucaggauguccgccucucg

SEQ ID NO: 2099 - RNA, 19 nt, artificial
  Chemically synthesized
uaacacaauagaggaagau

SEQ ID NO: 2100 - RNA, 19 nt, artificial
  Chemically synthesized
guuauagauccagguaaag

SEQ ID NO: 2101 - RNA, 19 nt, artificial
  Chemically synthesized
gagaaccuuaugguccagg

SEQ ID NO: 2102 - RNA, 19 nt, artificial
  Chemically synthesized
ggaugccuacuggguggag

SEQ ID NO: 2103 - RNA, 19 nt, artificial
  Chemically synthesized
cugauccuucauaugaagc

SEQ ID NO: 2104 - RNA, 19 nt, artificial
  Chemically synthesized
aucccaugugcguggccag

SEQ ID NO: 2105 - RNA, 19 nt, artificial
  Chemically synthesized
aaugugaaaaucaccgaug

SEQ ID NO: 2106 - RNA, 19 nt, artificial
  Chemically synthesized
auccagcacacgaauacac

SEQ ID NO: 2107 - RNA, 19 nt, artificial
  Chemically synthesized
uacagugagcgggaugccu

SEQ ID NO: 2108 - RNA, 19 nt, artificial
  Chemically synthesized
ucaauucagaauguaaguc

SEQ ID NO: 2109 - RNA, 19 nt, artificial
  Chemically synthesized
aauaacuucauuugcuccu

SEQ ID NO: 2110 - RNA, 19 nt, artificial
  Chemically synthesized
uuuucagaacuauccacug

SEQ ID NO: 2111 - RNA, 19 nt, artificial
  Chemically synthesized
uuuuucagaacuauccacu

SEQ ID NO: 2112 - RNA, 19 nt, artificial
  Chemically synthesized
uccugcugauccugcucac

SEQ ID NO: 2113 - RNA, 19 nt, artificial
  Chemically synthesized
uuccagaaauaaguugaug

SEQ ID NO: 2114 - RNA, 19 nt, artificial
  Chemically synthesized
aucuacagagcuaugagcc

SEQ ID NO: 2115 - RNA, 19 nt, artificial
  Chemically synthesized
aaugacagaguuauagauc

SEQ ID NO: 2116 - RNA, 19 nt, artificial
  Chemically synthesized
uagauccagguaaagugga

SEQ ID NO: 2117 - RNA, 19 nt, artificial
  Chemically synthesized
aaaugaugugggccuggcu

SEQ ID NO: 2118 - RNA, 19 nt, artificial
  Chemically synthesized
ugggccuggcuccaggcca

SEQ ID NO: 2119 - RNA, 19 nt, artificial
  Chemically synthesized
ugcugugcucuguuccugc

SEQ ID NO: 2120 - RNA, 19 nt, artificial
  Chemically synthesized
gaggaugccuggcccucuc

SEQ ID NO: 2121 - RNA, 19 nt, artificial
  Chemically synthesized
uaaacuuacugggaaaucc

SEQ ID NO: 2122 - RNA, 19 nt, artificial
  Chemically synthesized
auaagcgggacuucauucc

SEQ ID NO: 2123 - RNA, 19 nt, artificial
  Chemically synthesized
augaaaaugaugugggccu

SEQ ID NO: 2124 - RNA, 19 nt, artificial
  Chemically synthesized
cugugcucuguuccugcug

SEQ ID NO: 2125 - RNA, 19 nt, artificial
  Chemically synthesized
aaagaaaagauuuugcugg

SEQ ID NO: 2126 - RNA, 19 nt, artificial
  Chemically synthesized
aacaaugaugcugccauuc

SEQ ID NO: 2127 - RNA, 19 nt, artificial
  Chemically synthesized
gugagcgggaugccuacug

SEQ ID NO: 2128 - RNA, 19 nt, artificial
  Chemically synthesized
uuacugcuggagauuuuug

SEQ ID NO: 2129 - RNA, 19 nt, artificial
  Chemically synthesized
aguaaaguuuuucugguuc

SEQ ID NO: 2130 - RNA, 19 nt, artificial
  Chemically synthesized
uuuccgucuuuuugaugag

SEQ ID NO: 2131 - RNA, 19 nt, artificial
  Chemically synthesized
uugccgcaacucaaagaac

SEQ ID NO: 2132 - RNA, 19 nt, artificial
  Chemically synthesized
aauuugccgcaacucaaag

SEQ ID NO: 2133 - RNA, 19 nt, artificial
  Chemically synthesized
ucaggagcagcaagcacug

SEQ ID NO: 2134 - RNA, 19 nt, artificial
  Chemically synthesized
uggauggugugggucuugg

SEQ ID NO: 2135 - RNA, 19 nt, artificial
  Chemically synthesized
ugaccuguccaacaacagg

SEQ ID NO: 2136 - RNA, 19 nt, artificial
  Chemically synthesized
auauuugaacuuauccagc

SEQ ID NO: 2137 - RNA, 19 nt, artificial
  Chemically synthesized
aagaauccuccaaucaggc

SEQ ID NO: 2138 - RNA, 19 nt, artificial
  Chemically synthesized
ugacuccauugaaaagagc

SEQ ID NO: 2139 - RNA, 19 nt, artificial
  Chemically synthesized
cuucucugucuugugaccg

SEQ ID NO: 2140 - RNA, 19 nt, artificial
  Chemically synthesized
cagaugccucccucuuacc

SEQ ID NO: 2141 - RNA, 19 nt, artificial
  Chemically synthesized
ucuccaucccaugugcgug

SEQ ID NO: 2142 - RNA, 19 nt, artificial
  Chemically synthesized
cuuaugguccaggagcugg

SEQ ID NO: 2143 - RNA, 19 nt, artificial
  Chemically synthesized
guuccugcugauccugcuc

SEQ ID NO: 2144 - RNA, 19 nt, artificial
  Chemically synthesized
aagauucuuuuucuucccu

SEQ ID NO: 2145 - RNA, 19 nt, artificial
  Chemically synthesized
uucacucaggagcagcaag

SEQ ID NO: 2146 - RNA, 19 nt, artificial
  Chemically synthesized
aucuuuaaacuccauuccc

SEQ ID NO: 2147 - RNA, 19 nt, artificial
  Chemically synthesized
aagcccaggaaagcuccca

SEQ ID NO: 2148 - RNA, 19 nt, artificial
  Chemically synthesized
ugaaaaugaugugggccug

SEQ ID NO: 2149 - RNA, 19 nt, artificial
  Chemically synthesized
caagaccuaccuggagugg

SEQ ID NO: 2150 - RNA, 19 nt, artificial
  Chemically synthesized
ucccucuuacccauguuac

SEQ ID NO: 2151 - RNA, 19 nt, artificial
  Chemically synthesized
accuuccuugaggaacuug

SEQ ID NO: 2152 - RNA, 19 nt, artificial
  Chemically synthesized
aggaugccuggcccucucu

SEQ ID NO: 2153 - RNA, 19 nt, artificial
  Chemically synthesized
acacuggaaauuuuagaug

SEQ ID NO: 2154 - RNA, 19 nt, artificial
  Chemically synthesized
auccagguaaaguggaaac

SEQ ID NO: 2155 - RNA, 19 nt, artificial
  Chemically synthesized
ugacucuccaucccaugug

SEQ ID NO: 2156 - RNA, 19 nt, artificial
  Chemically synthesized
auuaacacaauagaggaag

SEQ ID NO: 2157 - RNA, 19 nt, artificial
  Chemically synthesized
uuuugcuggacuuaccuuc

SEQ ID NO: 2158 - RNA, 19 nt, artificial
  Chemically synthesized
uuugcuggacuuaccuucc

SEQ ID NO: 2159 - RNA, 19 nt, artificial
  Chemically synthesized
uuauagauccagguaaagu

SEQ ID NO: 2160 - RNA, 19 nt, artificial
  Chemically synthesized
uuggaacugcgagauacug

SEQ ID NO: 2161 - RNA, 19 nt, artificial
  Chemically synthesized
aaccuuaugguccaggagc

SEQ ID NO: 2162 - RNA, 19 nt, artificial
  Chemically synthesized
ugaggaugccuggcccucu

SEQ ID NO: 2163 - RNA, 19 nt, artificial
  Chemically synthesized
uugaacuuauccagcacac

SEQ ID NO: 2164 - RNA, 19 nt, artificial
  Chemically synthesized
ucuaccagaugccucccuc

SEQ ID NO: 2165 - RNA, 19 nt, artificial
  Chemically synthesized
uaaaguuuuucugguuccu

SEQ ID NO: 2166 - RNA, 19 nt, artificial
  Chemically synthesized
ugucuggcaugugcugugc

SEQ ID NO: 2167 - RNA, 19 nt, artificial
  Chemically synthesized
acauacuuuguggauggug

SEQ ID NO: 2168 - RNA, 19 nt, artificial
  Chemically synthesized
ugccucccucuuacccaug

SEQ ID NO: 2169 - RNA, 19 nt, artificial
  Chemically synthesized
uccuccaaucaggcuucuc

SEQ ID NO: 2170 - RNA, 19 nt, artificial
  Chemically synthesized
uuauccagcacacgaauac

SEQ ID NO: 2171 - RNA, 19 nt, artificial
  Chemically synthesized
gcgcuucugcaagcugcgg

SEQ ID NO: 2172 - RNA, 19 nt, artificial
  Chemically synthesized
auacuugaaaaauucagcc

SEQ ID NO: 2173 - RNA, 19 nt, artificial
  Chemically synthesized
gagcgggaugccuacuggg

SEQ ID NO: 2174 - RNA, 19 nt, artificial
  Chemically synthesized
uuccugcugauccugcuca

SEQ ID NO: 2175 - RNA, 19 nt, artificial
  Chemically synthesized
auucagccugugaggaugc

SEQ ID NO: 2176 - RNA, 19 nt, artificial
  Chemically synthesized
aaaaagccuugaccugucc

SEQ ID NO: 2177 - RNA, 19 nt, artificial
  Chemically synthesized
ugugaggaugccuggcccu

SEQ ID NO: 2178 - RNA, 19 nt, artificial
  Chemically synthesized
uguaacaggcugcauuccc

SEQ ID NO: 2179 - RNA, 19 nt, artificial
  Chemically synthesized
auagauccagguaaagugg

SEQ ID NO: 2180 - RNA, 19 nt, artificial
  Chemically synthesized
acucaggagcagcaagcac

SEQ ID NO: 2181 - RNA, 19 nt, artificial
  Chemically synthesized
uugcuccugugaauuccuc

SEQ ID NO: 2182 - RNA, 19 nt, artificial
  Chemically synthesized
augugcugugcucuguucc

SEQ ID NO: 2183 - RNA, 19 nt, artificial
  Chemically synthesized
auuggccagcaaauuaccu

SEQ ID NO: 2184 - RNA, 19 nt, artificial
  Chemically synthesized
gaagcccaggaaagcuccc

SEQ ID NO: 2185 - RNA, 19 nt, artificial
  Chemically synthesized
uaugaacuggacuucuccc

SEQ ID NO: 2186 - RNA, 19 nt, artificial
  Chemically synthesized
aauuaccugugugacucuc

SEQ ID NO: 2187 - RNA, 19 nt, artificial
  Chemically synthesized
uugugucuucauaagcggg

SEQ ID NO: 2188 - RNA, 19 nt, artificial
  Chemically synthesized
cuguuccugcugauccugc

SEQ ID NO: 2189 - RNA, 19 nt, artificial
  Chemically synthesized
gaccuaccuggaguggccc

SEQ ID NO: 2190 - RNA, 19 nt, artificial
  Chemically synthesized
aaugccacauacuuugugg

SEQ ID NO: 2191 - RNA, 19 nt, artificial
  Chemically synthesized
gccugugaggaugccuggc

SEQ ID NO: 2192 - RNA, 19 nt, artificial
  Chemically synthesized
uaugccugaaacuugucag

SEQ ID NO: 2193 - RNA, 19 nt, artificial
  Chemically synthesized
uuguuucuuacagugagcg

SEQ ID NO: 2194 - RNA, 19 nt, artificial
  Chemically synthesized
gaugugggccuggcuccag

SEQ ID NO: 2195 - RNA, 19 nt, artificial
  Chemically synthesized
uucaggauguccgccucuc

SEQ ID NO: 2196 - RNA, 19 nt, artificial
  Chemically synthesized
cugugaggaugccuggccc

SEQ ID NO: 2197 - RNA, 19 nt, artificial
  Chemically synthesized
ugagcgggaugccuacugg

SEQ ID NO: 2198 - RNA, 19 nt, artificial
  Chemically synthesized
uuuggguaaaucugagagc

SEQ ID NO: 2199 - RNA, 19 nt, artificial
  Chemically synthesized
uaaacuccauucccucagg

SEQ ID NO: 2200 - RNA, 19 nt, artificial
  Chemically synthesized
auuaccugugugacucucc

SEQ ID NO: 2201 - RNA, 19 nt, artificial
  Chemically synthesized
ucagccugugaggaugccu

SEQ ID NO: 2202 - RNA, 19 nt, artificial
  Chemically synthesized
uagaggaagauucuuuuuc

SEQ ID NO: 2203 - RNA, 19 nt, artificial
  Chemically synthesized
acucuccaucccaugugcg

SEQ ID NO: 2204 - RNA, 19 nt, artificial
  Chemically synthesized
uuugaauuugccgcaacuc

SEQ ID NO: 2205 - RNA, 19 nt, artificial
  Chemically synthesized
uuuuucuucccugggcagu

SEQ ID NO: 2206 - RNA, 19 nt, artificial
  Chemically synthesized
acuuuguggaugguguggg

SEQ ID NO: 2207 - RNA, 19 nt, artificial
  Chemically synthesized
uugaccuguccaacaacag

SEQ ID NO: 2208 - RNA, 19 nt, artificial
  Chemically synthesized
augaugugggccuggcucc

SEQ ID NO: 2209 - RNA, 19 nt, artificial
  Chemically synthesized
ccaggccaaaaggaagccc

SEQ ID NO: 2210 - RNA, 19 nt, artificial
  Chemically synthesized
ucacucaggagcagcaagc

SEQ ID NO: 2211 - RNA, 19 nt, artificial
  Chemically synthesized
aagaccuaccuggaguggc

SEQ ID NO: 2212 - RNA, 19 nt, artificial
  Chemically synthesized
uaccuggaguggcccaugg

SEQ ID NO: 2213 - RNA, 19 nt, artificial
  Chemically synthesized
uacuuuguggauggugugg

SEQ ID NO: 2214 - RNA, 19 nt, artificial
  Chemically synthesized
caggagcagcaagcacugg

SEQ ID NO: 2215 - RNA, 19 nt, artificial
  Chemically synthesized
aggagcagcaagcacuggc

SEQ ID NO: 2216 - RNA, 19 nt, artificial
  Chemically synthesized
ucuguuccugcugauccug

SEQ ID NO: 2217 - RNA, 19 nt, artificial
  Chemically synthesized
acucuaccagaugccuccc

SEQ ID NO: 2218 - RNA, 19 nt, artificial
  Chemically synthesized
gaaaaugaugugggccugg

SEQ ID NO: 2219 - RNA, 19 nt, artificial
  Chemically synthesized
augugggccuggcuccagg

SEQ ID NO: 2220 - RNA, 19 nt, artificial
  Chemically synthesized
aacaguaaaguuuuucugg

SEQ ID NO: 2221 - RNA, 19 nt, artificial
  Chemically synthesized
uccuucacucaggagcagc

SEQ ID NO: 2222 - RNA, 19 nt, artificial
  Chemically synthesized
uaugguccaggagcuggag

SEQ ID NO: 2223 - RNA, 19 nt, artificial
  Chemically synthesized
gugaggaugccuggcccuc

SEQ ID NO: 2224 - RNA, 19 nt, artificial
  Chemically synthesized
uccagguaaaguggaaacg

SEQ ID NO: 2225 - RNA, 19 nt, artificial
  Chemically synthesized
agaugccucccucuuaccc

SEQ ID NO: 2226 - RNA, 19 nt, artificial
  Chemically synthesized
aagcagcauauuuuacugc

SEQ ID NO: 2227 - RNA, 19 nt, artificial
  Chemically synthesized
ccaucccaugugcguggcc

SEQ ID NO: 2228 - RNA, 19 nt, artificial
  Chemically synthesized
aaugaugugggccuggcuc

SEQ ID NO: 2229 - RNA, 19 nt, artificial
  Chemically synthesized
uuuuggguaaaucugagag

SEQ ID NO: 2230 - RNA, 19 nt, artificial
  Chemically synthesized
uuuucuuugaauuugccgc

SEQ ID NO: 2231 - RNA, 19 nt, artificial
  Chemically synthesized
auucuuuuucuucccuggg

SEQ ID NO: 2232 - RNA, 19 nt, artificial
  Chemically synthesized
uuaaacuuacugggaaauc

SEQ ID NO: 2233 - RNA, 19 nt, artificial
  Chemically synthesized
uuggccagcaaauuaccug

SEQ ID NO: 2234 - RNA, 19 nt, artificial
  Chemically synthesized
auuuucuuugaauuugccg

SEQ ID NO: 2235 - RNA, 19 nt, artificial
  Chemically synthesized
uucuuuuucuucccugggc

SEQ ID NO: 2236 - RNA, 19 nt, artificial
  Chemically synthesized
ccugugaggaugccuggcc

SEQ ID NO: 2237 - RNA, 19 nt, artificial
  Chemically synthesized
uccaucccaugugcguggc

SEQ ID NO: 2238 - RNA, 19 nt, artificial
  Chemically synthesized
uuaaacuccauucccucag

SEQ ID NO: 2239 - RNA, 19 nt, artificial
  Chemically synthesized
uccaggccaaaaggaagcc

SEQ ID NO: 2240 - RNA, 19 nt, artificial
  Chemically synthesized
ugugggccuggcuccaggc

SEQ ID NO: 2241 - RNA, 19 nt, artificial
  Chemically synthesized
aaaaugaugugggccuggc

SEQ ID NO: 2242 - RNA, 19 nt, artificial
  Chemically synthesized
uuuguggaugguguggguc

SEQ ID NO: 2243 - RNA, 19 nt, artificial
  Chemically synthesized
ucccaugugcguggccagc

SEQ ID NO: 2244 - RNA, 19 nt, artificial
  Chemically synthesized
uuacagugagcgggaugcc

SEQ ID NO: 2245 - RNA, 19 nt, artificial
  Chemically synthesized
uaugaaaaugaugugggcc

SEQ ID NO: 2246 - RNA, 19 nt, artificial
  Chemically synthesized
uucagccugugaggaugcc

SEQ ID NO: 2247 - RNA, 19 nt, artificial
  Chemically synthesized
ggcuuuuuucucaaugggc

SEQ ID NO: 2248 - RNA, 19 nt, artificial
  Chemically synthesized
aguuuaaagauccugagcu

SEQ ID NO: 2249 - RNA, 19 nt, artificial
  Chemically synthesized
gaaacgguggcacaggacc

SEQ ID NO: 2250 - RNA, 19 nt, artificial
  Chemically synthesized
cucuguaggucacuguugc

SEQ ID NO: 2251 - RNA, 19 nt, artificial
  Chemically synthesized
gaaugcagccuguuacacu

SEQ ID NO: 2252 - RNA, 19 nt, artificial
  Chemically synthesized
aacauuccacggaacuugu

SEQ ID NO: 2253 - RNA, 19 nt, artificial
  Chemically synthesized
ucggugauuuucacauuuc

SEQ ID NO: 2254 - RNA, 19 nt, artificial
  Chemically synthesized
gaagguguccauauuuccc

SEQ ID NO: 2255 - RNA, 19 nt, artificial
  Chemically synthesized
ugauauugucaaugaucca

SEQ ID NO: 2256 - RNA, 19 nt, artificial
  Chemically synthesized
gaaucuuagugaagguguc

SEQ ID NO: 2257 - RNA, 19 nt, artificial
  Chemically synthesized
gucuugggaaugcagccug

SEQ ID NO: 2258 - RNA, 19 nt, artificial
  Chemically synthesized
aaaaucuccagcaguaaaa

SEQ ID NO: 2259 - RNA, 19 nt, artificial
  Chemically synthesized
guguuaauuccauuggaug

SEQ ID NO: 2260 - RNA, 19 nt, artificial
  Chemically synthesized
uccauuaaggguacaguca

SEQ ID NO: 2261 - RNA, 19 nt, artificial
  Chemically synthesized
uaggcaucccgcucacugu

SEQ ID NO: 2262 - RNA, 19 nt, artificial
  Chemically synthesized
uuuuggccuggagccaggc

SEQ ID NO: 2263 - RNA, 19 nt, artificial
  Chemically synthesized
ugcuaauguaggugauccu

SEQ ID NO: 2264 - RNA, 19 nt, artificial
  Chemically synthesized
aaggaucagaugacuuaca

SEQ ID NO: 2265 - RNA, 19 nt, artificial
  Chemically synthesized
gucuugguguucauuaucu

SEQ ID NO: 2266 - RNA, 19 nt, artificial
  Chemically synthesized
uauugucaaugauccacuu

SEQ ID NO: 2267 - RNA, 19 nt, artificial
  Chemically synthesized
cuuccuuuuggccuggagc

SEQ ID NO: 2268 - RNA, 19 nt, artificial
  Chemically synthesized
guucauuaucuuccgcagc

SEQ ID NO: 2269 - RNA, 19 nt, artificial
  Chemically synthesized
uggagucaaugauauuguc

SEQ ID NO: 2270 - RNA, 19 nt, artificial
  Chemically synthesized
cucacuguaagaaacaaau

SEQ ID NO: 2271 - RNA, 19 nt, artificial
  Chemically synthesized
caaaucaguaucucgcagu

SEQ ID NO: 2272 - RNA, 19 nt, artificial
  Chemically synthesized
agaucugaagcaucaaucu

SEQ ID NO: 2273 - RNA, 19 nt, artificial
  Chemically synthesized
uuuggccuggagccaggcc

SEQ ID NO: 2274 - RNA, 19 nt, artificial
  Chemically synthesized
auuggaugucagcaccaga

SEQ ID NO: 2275 - RNA, 19 nt, artificial
  Chemically synthesized
ucuccacccaguaggcauc

SEQ ID NO: 2276 - RNA, 19 nt, artificial
  Chemically synthesized
gauugaaguucuccagcuc

SEQ ID NO: 2277 - RNA, 19 nt, artificial
  Chemically synthesized
ccuguuacacuguguauuc

SEQ ID NO: 2278 - RNA, 19 nt, artificial
  Chemically synthesized
ugcagccuguuacacugug

SEQ ID NO: 2279 - RNA, 19 nt, artificial
  Chemically synthesized
gaggcggacauccugaacc

SEQ ID NO: 2280 - RNA, 19 nt, artificial
  Chemically synthesized
ucuguaggucacuguugcu

SEQ ID NO: 2281 - RNA, 19 nt, artificial
  Chemically synthesized
cuccauuaaggguacaguc

SEQ ID NO: 2282 - RNA, 19 nt, artificial
  Chemically synthesized
cauccacaaaguauguggc

SEQ ID NO: 2283 - RNA, 19 nt, artificial
  Chemically synthesized
gguaaguccagcaaaaucu

SEQ ID NO: 2284 - RNA, 19 nt, artificial
  Chemically synthesized
ugagauuguuguugcuaac

SEQ ID NO: 2285 - RNA, 19 nt, artificial
  Chemically synthesized
gucacaagacagagaagcc

SEQ ID NO: 2286 - RNA, 19 nt, artificial
  Chemically synthesized
cacacagguaauuugcugg

SEQ ID NO: 2287 - RNA, 19 nt, artificial
  Chemically synthesized
acuugcaccacucacucuu

SEQ ID NO: 2288 - RNA, 19 nt, artificial
  Chemically synthesized
gagucaucaacuuauuucu

SEQ ID NO: 2289 - RNA, 19 nt, artificial
  Chemically synthesized
ucuaaaauuuccagugucu

SEQ ID NO: 2290 - RNA, 19 nt, artificial
  Chemically synthesized
aaagauccugagcugcccu

SEQ ID NO: 2291 - RNA, 19 nt, artificial
  Chemically synthesized
ggguuuuguaaggauuucc

SEQ ID NO: 2292 - RNA, 19 nt, artificial
  Chemically synthesized
ucuuccuuggagaggcuga

SEQ ID NO: 2293 - RNA, 19 nt, artificial
  Chemically synthesized
auaaagugcucagaucaua

SEQ ID NO: 2294 - RNA, 19 nt, artificial
  Chemically synthesized
ucacaggagcaaaugaagu

SEQ ID NO: 2295 - RNA, 19 nt, artificial
  Chemically synthesized
acaaaguuuucagaaagca

SEQ ID NO: 2296 - RNA, 19 nt, artificial
  Chemically synthesized
aagacaguuuuguggcucu

SEQ ID NO: 2297 - RNA, 19 nt, artificial
  Chemically synthesized
acaugccagacaccagugc

SEQ ID NO: 2298 - RNA, 19 nt, artificial
  Chemically synthesized
cgcagcucucagauuuacc

SEQ ID NO: 2299 - RNA, 19 nt, artificial
  Chemically synthesized
ggaagaaaaagaaucuucc

SEQ ID NO: 2300 - RNA, 19 nt, artificial
  Chemically synthesized
uuuccacuuuaccuggauc

SEQ ID NO: 2301 - RNA, 19 nt, artificial
  Chemically synthesized
gauauugucaaugauccac

SEQ ID NO: 2302 - RNA, 19 nt, artificial
  Chemically synthesized
gauuggaggauucuuccuu

SEQ ID NO: 2303 - RNA, 19 nt, artificial
  Chemically synthesized
guuacacuguguauucgug

SEQ ID NO: 2304 - RNA, 19 nt, artificial
  Chemically synthesized
aauaugcugcuucauauga

SEQ ID NO: 2305 - RNA, 19 nt, artificial
  Chemically synthesized
aucuuccgcagcuugcaga

SEQ ID NO: 2306 - RNA, 19 nt, artificial
  Chemically synthesized
ccauccacaaaguaugugg

SEQ ID NO: 2307 - RNA, 19 nt, artificial
  Chemically synthesized
accagcuuccaaagucuuc

SEQ ID NO: 2308 - RNA, 19 nt, artificial
  Chemically synthesized
auugagauuguuguugcua

SEQ ID NO: 2309 - RNA, 19 nt, artificial
  Chemically synthesized
ggucacaagacagagaagc

SEQ ID NO: 2310 - RNA, 19 nt, artificial
  Chemically synthesized
uugcaccacucacucuuca

SEQ ID NO: 2311 - RNA, 19 nt, artificial
  Chemically synthesized
ugcugcuucauaugaagga

SEQ ID NO: 2312 - RNA, 19 nt, artificial
  Chemically synthesized
uuauugccaccagcuucca

SEQ ID NO: 2313 - RNA, 19 nt, artificial
  Chemically synthesized
uuguagagagggccaggca

SEQ ID NO: 2314 - RNA, 19 nt, artificial
  Chemically synthesized
ugggcuuccuuuuggccug

SEQ ID NO: 2315 - RNA, 19 nt, artificial
  Chemically synthesized
augaaguuauugccaccag

SEQ ID NO: 2316 - RNA, 19 nt, artificial
  Chemically synthesized
ucauagcucuguagaucug

SEQ ID NO: 2317 - RNA, 19 nt, artificial
  Chemically synthesized
agucaucaacuuauuucug

SEQ ID NO: 2318 - RNA, 19 nt, artificial
  Chemically synthesized
ccagcuuccaaagucuuca

SEQ ID NO: 2319 - RNA, 19 nt, artificial
  Chemically synthesized
agugcuugcugcuccugag

SEQ ID NO: 2320 - RNA, 19 nt, artificial
  Chemically synthesized
aucuaaaauuuccaguguc

SEQ ID NO: 2321 - RNA, 19 nt, artificial
  Chemically synthesized
aggucuugguguucauuau

SEQ ID NO: 2322 - RNA, 19 nt, artificial
  Chemically synthesized
cuacugugauucuuuuaac

SEQ ID NO: 2323 - RNA, 19 nt, artificial
  Chemically synthesized
aauuuguuucaccagugga

SEQ ID NO: 2324 - RNA, 19 nt, artificial
  Chemically synthesized
ucaguaucucgcaguucca

SEQ ID NO: 2325 - RNA, 19 nt, artificial
  Chemically synthesized
aaaucuccagcaguaaaau

SEQ ID NO: 2326 - RNA, 19 nt, artificial
  Chemically synthesized
cuugguguucauuaucuuc

SEQ ID NO: 2327 - RNA, 19 nt, artificial
  Chemically synthesized
acacagguaauuugcuggc

SEQ ID NO: 2328 - RNA, 19 nt, artificial
  Chemically synthesized
acuugccaggaaugaaguc

SEQ ID NO: 2329 - RNA, 19 nt, artificial
  Chemically synthesized
ucagcaggaacagagcaca

SEQ ID NO: 2330 - RNA, 19 nt, artificial
  Chemically synthesized
ggauugaaguucuccagcu

SEQ ID NO: 2331 - RNA, 19 nt, artificial
  Chemically synthesized
aauuuccagugucuuggga

SEQ ID NO: 2332 - RNA, 19 nt, artificial
  Chemically synthesized
uagugaagguguccauauu

SEQ ID NO: 2333 - RNA, 19 nt, artificial
  Chemically synthesized
ccacuugccaggaaugaag

SEQ ID NO: 2334 - RNA, 19 nt, artificial
  Chemically synthesized
uccuguuguuggacagguc

SEQ ID NO: 2335 - RNA, 19 nt, artificial
  Chemically synthesized
aguuccucaaggaagguaa

SEQ ID NO: 2336 - RNA, 19 nt, artificial
  Chemically synthesized
uauaaagugcucagaucau

SEQ ID NO: 2337 - RNA, 19 nt, artificial
  Chemically synthesized
uaggguuuuguaaggauuu

SEQ ID NO: 2338 - RNA, 19 nt, artificial
  Chemically synthesized
gcaucugguagagucauca

SEQ ID NO: 2339 - RNA, 19 nt, artificial
  Chemically synthesized
gagaaguccaguucauacu

SEQ ID NO: 2340 - RNA, 19 nt, artificial
  Chemically synthesized
ugagucaaguugcuccuua

SEQ ID NO: 2341 - RNA, 19 nt, artificial
  Chemically synthesized
accuggaucuauaacucug

SEQ ID NO: 2342 - RNA, 19 nt, artificial
  Chemically synthesized
gacuucaaacuuuuuggcu

SEQ ID NO: 2343 - RNA, 19 nt, artificial
  Chemically synthesized
gaucugaagcaucaaucuc

SEQ ID NO: 2344 - RNA, 19 nt, artificial
  Chemically synthesized
gucacuguugcuaauguag

SEQ ID NO: 2345 - RNA, 19 nt, artificial
  Chemically synthesized
uucccaguaaguuuaagaa

SEQ ID NO: 2346 - RNA, 19 nt, artificial
  Chemically synthesized
uuaaggguacagucaucaa

SEQ ID NO: 2347 - RNA, 19 nt, artificial
  Chemically synthesized
guccaguucauacuugcac

SEQ ID NO: 2348 - RNA, 19 nt, artificial
  Chemically synthesized
acucuucacaaaguuuuca

SEQ ID NO: 2349 - RNA, 19 nt, artificial
  Chemically synthesized
ccucuauuguguuaauucc

SEQ ID NO: 2350 - RNA, 19 nt, artificial
  Chemically synthesized
caucaaucucaaguuccuc

SEQ ID NO: 2351 - RNA, 19 nt, artificial
  Chemically synthesized
gucaucaacuuauuucugg

SEQ ID NO: 2352 - RNA, 19 nt, artificial
  Chemically synthesized
ucuuccucuauuguguuaa

SEQ ID NO: 2353 - RNA, 19 nt, artificial
  Chemically synthesized
augccagacaccagugcug

SEQ ID NO: 2354 - RNA, 19 nt, artificial
  Chemically synthesized
acuguguauucgugugcug

SEQ ID NO: 2355 - RNA, 19 nt, artificial
  Chemically synthesized
auucgugugcuggauaagu

SEQ ID NO: 2356 - RNA, 19 nt, artificial
  Chemically synthesized
aaguugcuccuuagaaaac

SEQ ID NO: 2357 - RNA, 19 nt, artificial
  Chemically synthesized
aguucuccagcuccuggac

SEQ ID NO: 2358 - RNA, 19 nt, artificial
  Chemically synthesized
aaagcacaaagacaguuuu

SEQ ID NO: 2359 - RNA, 19 nt, artificial
  Chemically synthesized
gaagcaucaaucucaaguu

SEQ ID NO: 2360 - RNA, 19 nt, artificial
  Chemically synthesized
gaaaaaagagauguuuccc

SEQ ID NO: 2361 - RNA, 19 nt, artificial
  Chemically synthesized
caaugaauuuguuucacca

SEQ ID NO: 2362 - RNA, 19 nt, artificial
  Chemically synthesized
ucuuuucuggccacugaca

SEQ ID NO: 2363 - RNA, 19 nt, artificial
  Chemically synthesized
cauuaucuuccgcagcuug

SEQ ID NO: 2364 - RNA, 19 nt, artificial
  Chemically synthesized
cagucaucaaacucuaauu

SEQ ID NO: 2365 - RNA, 19 nt, artificial
  Chemically synthesized
cuuucaucggugauuuuca

SEQ ID NO: 2366 - RNA, 19 nt, artificial
  Chemically synthesized
augaaggaucagaugacuu

SEQ ID NO: 2367 - RNA, 19 nt, artificial
  Chemically synthesized
aguuuuguggcucuuuuca

SEQ ID NO: 2368 - RNA, 19 nt, artificial
  Chemically synthesized
aauucacaggagcaaauga

SEQ ID NO: 2369 - RNA, 19 nt, artificial
  Chemically synthesized
aacaaggaaccagaaaaac

SEQ ID NO: 2370 - RNA, 19 nt, artificial
  Chemically synthesized
cgcuuaugaagacacaacu

SEQ ID NO: 2371 - RNA, 19 nt, artificial
  Chemically synthesized
aagacggaaaugggagaag

SEQ ID NO: 2372 - RNA, 19 nt, artificial
  Chemically synthesized
ucugaaaaauggaaagugu

SEQ ID NO: 2373 - RNA, 19 nt, artificial
  Chemically synthesized
aaaucaguaucucgcaguu

SEQ ID NO: 2374 - RNA, 19 nt, artificial
  Chemically synthesized
cacaagacagagaagccug

SEQ ID NO: 2375 - RNA, 19 nt, artificial
  Chemically synthesized
aagcacaaagacaguuuug

SEQ ID NO: 2376 - RNA, 19 nt, artificial
  Chemically synthesized
uguuucaccaguggauagu

SEQ ID NO: 2377 - RNA, 19 nt, artificial
  Chemically synthesized
gucaaugauauugucaaug

SEQ ID NO: 2378 - RNA, 19 nt, artificial
  Chemically synthesized
gauccaaguauucuaauga

SEQ ID NO: 2379 - RNA, 19 nt, artificial
  Chemically synthesized
guuuuguaaggauuuccca

SEQ ID NO: 2380 - RNA, 19 nt, artificial
  Chemically synthesized
agcacaugccagacaccag

SEQ ID NO: 2381 - RNA, 19 nt, artificial
  Chemically synthesized
agauccugagcugcccuug

SEQ ID NO: 2382 - RNA, 19 nt, artificial
  Chemically synthesized
ugguagagucaucaacuua

SEQ ID NO: 2383 - RNA, 19 nt, artificial
  Chemically synthesized
ugagaugagaaaaaagaga

SEQ ID NO: 2384 - RNA, 19 nt, artificial
  Chemically synthesized
aucucaaguuccucaagga

SEQ ID NO: 2385 - RNA, 19 nt, artificial
  Chemically synthesized
caaggaagguaaguccagc

SEQ ID NO: 2386 - RNA, 19 nt, artificial
  Chemically synthesized
aaugaagucccgcuuauga

SEQ ID NO: 2387 - RNA, 19 nt, artificial
  Chemically synthesized
uggcucauagcucuguaga

SEQ ID NO: 2388 - RNA, 19 nt, artificial
  Chemically synthesized
ugccaggaaugaagucccg

SEQ ID NO: 2389 - RNA, 19 nt, artificial
  Chemically synthesized
augaauuuguuucaccagu

SEQ ID NO: 2390 - RNA, 19 nt, artificial
  Chemically synthesized
uaaguccagcaaaaucuuu

SEQ ID NO: 2391 - RNA, 19 nt, artificial
  Chemically synthesized
acaguuuuguggcucuuuu

SEQ ID NO: 2392 - RNA, 19 nt, artificial
  Chemically synthesized
uggcucuuuucaauggagu

SEQ ID NO: 2393 - RNA, 19 nt, artificial
  Chemically synthesized
uggcagcaucauuguucuc

SEQ ID NO: 2394 - RNA, 19 nt, artificial
  Chemically synthesized
ucauuaucuuccgcagcuu

SEQ ID NO: 2395 - RNA, 19 nt, artificial
  Chemically synthesized
cagcaguaaaauaugcugc

SEQ ID NO: 2396 - RNA, 19 nt, artificial
  Chemically synthesized
uggagaggcugaugaugac

SEQ ID NO: 2397 - RNA, 19 nt, artificial
  Chemically synthesized
aaguuuguagagagggcca

SEQ ID NO: 2398 - RNA, 19 nt, artificial
  Chemically synthesized
uccugagcugcccuugcag

SEQ ID NO: 2399 - RNA, 19 nt, artificial
  Chemically synthesized
cagagaagccugauuggag

SEQ ID NO: 2400 - RNA, 19 nt, artificial
  Chemically synthesized
uacuaguaacauggguaag

SEQ ID NO: 2401 - RNA, 19 nt, artificial
  Chemically synthesized
caguuuuguggcucuuuuc

SEQ ID NO: 2402 - RNA, 19 nt, artificial
  Chemically synthesized
auggaguuuaaagauccug

SEQ ID NO: 2403 - RNA, 19 nt, artificial
  Chemically synthesized
auggaaacgguggcacagg

SEQ ID NO: 2404 - RNA, 19 nt, artificial
  Chemically synthesized
caguuccaaacauuccacg

SEQ ID NO: 2405 - RNA, 19 nt, artificial
  Chemically synthesized
uccgcagcuugcagaagcg

SEQ ID NO: 2406 - RNA, 19 nt, artificial
  Chemically synthesized
ccugugacauuccgacacc

SEQ ID NO: 2407 - RNA, 19 nt, artificial
  Chemically synthesized
ucaucaaaaagacggaaau

SEQ ID NO: 2408 - RNA, 19 nt, artificial
  Chemically synthesized
cuuuucaauggagucaaug

SEQ ID NO: 2409 - RNA, 19 nt, artificial
  Chemically synthesized
ugcuggauaaguucaaaua

SEQ ID NO: 2410 - RNA, 19 nt, artificial
  Chemically synthesized
aagucccgcuuaugaagac

SEQ ID NO: 2411 - RNA, 19 nt, artificial
  Chemically synthesized
ggaccauaagguucuccac

SEQ ID NO: 2412 - RNA, 19 nt, artificial
  Chemically synthesized
uuggccagugcuugcugcu

SEQ ID NO: 2413 - RNA, 19 nt, artificial
  Chemically synthesized
gaaguuauugccaccagcu

SEQ ID NO: 2414 - RNA, 19 nt, artificial
  Chemically synthesized
caugccagacaccagugcu

SEQ ID NO: 2415 - RNA, 19 nt, artificial
  Chemically synthesized
gaaucuuccucuauugugu

SEQ ID NO: 2416 - RNA, 19 nt, artificial
  Chemically synthesized
caguaaaauaugcugcuuc

SEQ ID NO: 2417 - RNA, 19 nt, artificial
  Chemically synthesized
aaucuuccucuauuguguu

SEQ ID NO: 2418 - RNA, 19 nt, artificial
  Chemically synthesized
agagcacagcacaugccag

SEQ ID NO: 2419 - RNA, 19 nt, artificial
  Chemically synthesized
cugaaacaaacuuucaucg

SEQ ID NO: 2420 - RNA, 19 nt, artificial
  Chemically synthesized
cugcuucauaugaaggauc

SEQ ID NO: 2421 - RNA, 19 nt, artificial
  Chemically synthesized
auagcucuguagaucugaa

SEQ ID NO: 2422 - RNA, 19 nt, artificial
  Chemically synthesized
agucaaguuuuucagagug

SEQ ID NO: 2423 - RNA, 19 nt, artificial
  Chemically synthesized
cagcaucauuguucucauc

SEQ ID NO: 2424 - RNA, 19 nt, artificial
  Chemically synthesized
acagcacaugccagacacc

SEQ ID NO: 2425 - RNA, 19 nt, artificial
  Chemically synthesized
ugcuucauaugaaggauca

SEQ ID NO: 2426 - RNA, 19 nt, artificial
  Chemically synthesized
agcaggaacagagcacagc

SEQ ID NO: 2427 - RNA, 19 nt, artificial
  Chemically synthesized
cuaacaauccagaaaucug

SEQ ID NO: 2428 - RNA, 19 nt, artificial
  Chemically synthesized
auuucccaguaaguuuaag

SEQ ID NO: 2429 - RNA, 19 nt, artificial
  Chemically synthesized
uuggacaggucaaggcuuu

SEQ ID NO: 2430 - RNA, 19 nt, artificial
  Chemically synthesized
guaagagggaggcaucugg

SEQ ID NO: 2431 - RNA, 19 nt, artificial
  Chemically synthesized
aaggauuucccaguaaguu

SEQ ID NO: 2432 - RNA, 19 nt, artificial
  Chemically synthesized
augaagucccgcuuaugaa

SEQ ID NO: 2433 - RNA, 19 nt, artificial
  Chemically synthesized
cccaagacccacaccaucc

SEQ ID NO: 2434 - RNA, 19 nt, artificial
  Chemically synthesized
agcacaaagacaguuuugu

SEQ ID NO: 2435 - RNA, 19 nt, artificial
  Chemically synthesized
aguaucucgcaguuccaaa

SEQ ID NO: 2436 - RNA, 19 nt, artificial
  Chemically synthesized
auggguaagagggaggcau

SEQ ID NO: 2437 - RNA, 19 nt, artificial
  Chemically synthesized
cagcuuccaaagucuucag

SEQ ID NO: 2438 - RNA, 19 nt, artificial
  Chemically synthesized
acauggguaagagggaggc

SEQ ID NO: 2439 - RNA, 19 nt, artificial
  Chemically synthesized
acuuuacuguuuucuacug

SEQ ID NO: 2440 - RNA, 19 nt, artificial
  Chemically synthesized
uccagcaaaaucuuuucuu

SEQ ID NO: 2441 - RNA, 19 nt, artificial
  Chemically synthesized
agggaauggaguuuaaaga

SEQ ID NO: 2442 - RNA, 19 nt, artificial
  Chemically synthesized
cucgcaguuccaaacauuc

SEQ ID NO: 2443 - RNA, 19 nt, artificial
  Chemically synthesized
guuuucuacugugauucuu

SEQ ID NO: 2444 - RNA, 19 nt, artificial
  Chemically synthesized
ugcuugcugcuccugagug

SEQ ID NO: 2445 - RNA, 19 nt, artificial
  Chemically synthesized
aucucgcaguuccaaacau

SEQ ID NO: 2446 - RNA, 19 nt, artificial
  Chemically synthesized
gaaguucuccagcuccugg

SEQ ID NO: 2447 - RNA, 19 nt, artificial
  Chemically synthesized
gguucuccacccaguaggc

SEQ ID NO: 2448 - RNA, 19 nt, artificial
  Chemically synthesized
cucauagcucuguagaucu

SEQ ID NO: 2449 - RNA, 19 nt, artificial
  Chemically synthesized
uaugcagccuccggauugu

SEQ ID NO: 2450 - RNA, 19 nt, artificial
  Chemically synthesized
agguaggucuugguguuca

SEQ ID NO: 2451 - RNA, 19 nt, artificial
  Chemically synthesized
cuuuccugggcuuccuuuu

SEQ ID NO: 2452 - RNA, 19 nt, artificial
  Chemically synthesized
ggauaguucugaaaaaugg

SEQ ID NO: 2453 - RNA, 19 nt, artificial
  Chemically synthesized
cucacaggcugaauuuuuc

SEQ ID NO: 2454 - RNA, 19 nt, artificial
  Chemically synthesized
ucugaagcaucaaucucaa

SEQ ID NO: 2455 - RNA, 19 nt, artificial
  Chemically synthesized
ggguacagucaucaaacuc

SEQ ID NO: 2456 - RNA, 19 nt, artificial
  Chemically synthesized
acucacucuucacaaaguu

SEQ ID NO: 2457 - RNA, 19 nt, artificial
  Chemically synthesized
cucuauuguguuaauucca

SEQ ID NO: 2458 - RNA, 19 nt, artificial
  Chemically synthesized
guaggcaucccgcucacug

SEQ ID NO: 2459 - RNA, 19 nt, artificial
  Chemically synthesized
augcagccuguuacacugu

SEQ ID NO: 2460 - RNA, 19 nt, artificial
  Chemically synthesized
ucuugggaaugcagccugu

SEQ ID NO: 2461 - RNA, 19 nt, artificial
  Chemically synthesized
guuuguagagagggccagg

SEQ ID NO: 2462 - RNA, 19 nt, artificial
  Chemically synthesized
ggagaggcugaugaugacc

SEQ ID NO: 2463 - RNA, 19 nt, artificial
  Chemically synthesized
agcaguaaaauaugcugcu

SEQ ID NO: 2464 - RNA, 19 nt, artificial
  Chemically synthesized
uacagucaucaaacucuaa

SEQ ID NO: 2465 - RNA, 19 nt, artificial
  Chemically synthesized
gaaguccaguucauacuug

SEQ ID NO: 2466 - RNA, 19 nt, artificial
  Chemically synthesized
uguugcuaauguaggugau

SEQ ID NO: 2467 - RNA, 19 nt, artificial
  Chemically synthesized
ucgcagcucucagauuuac

SEQ ID NO: 2468 - RNA, 19 nt, artificial
  Chemically synthesized
acuguuuucuacugugauu

SEQ ID NO: 2469 - RNA, 19 nt, artificial
  Chemically synthesized
uccacuugccaggaaugaa

SEQ ID NO: 2470 - RNA, 19 nt, artificial
  Chemically synthesized
caucauuguucucaucaaa

SEQ ID NO: 2471 - RNA, 19 nt, artificial
  Chemically synthesized
gggauugaaguucuccagc

SEQ ID NO: 2472 - RNA, 19 nt, artificial
  Chemically synthesized
ccaggaaugaagucccgcu

SEQ ID NO: 2473 - RNA, 19 nt, artificial
  Chemically synthesized
ucaaacuuuuuggcucaua

SEQ ID NO: 2474 - RNA, 19 nt, artificial
  Chemically synthesized
cacucuucacaaaguuuuc

SEQ ID NO: 2475 - RNA, 19 nt, artificial
  Chemically synthesized
gucccgcuuaugaagacac

SEQ ID NO: 2476 - RNA, 19 nt, artificial
  Chemically synthesized
aggauucuuccuuggagag

SEQ ID NO: 2477 - RNA, 19 nt, artificial
  Chemically synthesized
uugggaaugcagccuguua

SEQ ID NO: 2478 - RNA, 19 nt, artificial
  Chemically synthesized
uccacccaguaggcauccc

SEQ ID NO: 2479 - RNA, 19 nt, artificial
  Chemically synthesized
ggucuugguguucauuauc

SEQ ID NO: 2480 - RNA, 19 nt, artificial
  Chemically synthesized
gaaggaucagaugacuuac

SEQ ID NO: 2481 - RNA, 19 nt, artificial
  Chemically synthesized
uccaaacauuccacggaac

SEQ ID NO: 2482 - RNA, 19 nt, artificial
  Chemically synthesized
auccugagcugcccuugca

SEQ ID NO: 2483 - RNA, 19 nt, artificial
  Chemically synthesized
augggagaaguccaguuca

SEQ ID NO: 2484 - RNA, 19 nt, artificial
  Chemically synthesized
gaauucacaggagcaaaug

SEQ ID NO: 2485 - RNA, 19 nt, artificial
  Chemically synthesized
uugcugcuccugagugaag

SEQ ID NO: 2486 - RNA, 19 nt, artificial
  Chemically synthesized
aaugauccacuugccagga

SEQ ID NO: 2487 - RNA, 19 nt, artificial
  Chemically synthesized
aacaauccagaaaucugau

SEQ ID NO: 2488 - RNA, 19 nt, artificial
  Chemically synthesized
uguggcucuuuucaaugga

SEQ ID NO: 2489 - RNA, 19 nt, artificial
  Chemically synthesized
aauuugcuggccaaucaau

SEQ ID NO: 2490 - RNA, 19 nt, artificial
  Chemically synthesized
uggaguuuaaagauccuga

SEQ ID NO: 2491 - RNA, 19 nt, artificial
  Chemically synthesized
agaaagcacaaagacaguu

SEQ ID NO: 2492 - RNA, 19 nt, artificial
  Chemically synthesized
cauuggaugucagcaccag

SEQ ID NO: 2493 - RNA, 19 nt, artificial
  Chemically synthesized
agacuuuggccagugcuug

SEQ ID NO: 2494 - RNA, 19 nt, artificial
  Chemically synthesized
uggaggauucuuccuugga

SEQ ID NO: 2495 - RNA, 19 nt, artificial
  Chemically synthesized
agaugacuuacauucugaa

SEQ ID NO: 2496 - RNA, 19 nt, artificial
  Chemically synthesized
aaucuccagcaguaaaaua

SEQ ID NO: 2497 - RNA, 19 nt, artificial
  Chemically synthesized
cuucauaugaaggaucaga

SEQ ID NO: 2498 - RNA, 19 nt, artificial
  Chemically synthesized
cuguuacacuguguauucg

SEQ ID NO: 2499 - RNA, 19 nt, artificial
  Chemically synthesized
ggaugucagcaccagagcc

SEQ ID NO: 2500 - RNA, 19 nt, artificial
  Chemically synthesized
accauccacaaaguaugug

SEQ ID NO: 2501 - RNA, 19 nt, artificial
  Chemically synthesized
uggguaagagggaggcauc

SEQ ID NO: 2502 - RNA, 19 nt, artificial
  Chemically synthesized
guuguuggacaggucaagg

SEQ ID NO: 2503 - RNA, 19 nt, artificial
  Chemically synthesized
aggauuucccaguaaguuu

SEQ ID NO: 2504 - RNA, 19 nt, artificial
  Chemically synthesized
cucaaguuccucaaggaag

SEQ ID NO: 2505 - RNA, 19 nt, artificial
  Chemically synthesized
gagucacacagguaauuug

SEQ ID NO: 2506 - RNA, 19 nt, artificial
  Chemically synthesized
caccucuguaggucacugu

SEQ ID NO: 2507 - RNA, 19 nt, artificial
  Chemically synthesized
aguccagcaaaaucuuuuc

SEQ ID NO: 2508 - RNA, 19 nt, artificial
  Chemically synthesized
agaaguccaguucauacuu

SEQ ID NO: 2509 - RNA, 19 nt, artificial
  Chemically synthesized
uaauuugcuggccaaucaa

SEQ ID NO: 2510 - RNA, 19 nt, artificial
  Chemically synthesized
ggaggcaucugguagaguc

SEQ ID NO: 2511 - RNA, 19 nt, artificial
  Chemically synthesized
guaaggauuucccaguaag

SEQ ID NO: 2512 - RNA, 19 nt, artificial
  Chemically synthesized
agacggaaaugggagaagu

SEQ ID NO: 2513 - RNA, 19 nt, artificial
  Chemically synthesized
cuguguauucgugugcugg

SEQ ID NO: 2514 - RNA, 19 nt, artificial
  Chemically synthesized
caauuuugugagaugagaa

SEQ ID NO: 2515 - RNA, 19 nt, artificial
  Chemically synthesized
gaaugaagucccgcuuaug

SEQ ID NO: 2516 - RNA, 19 nt, artificial
  Chemically synthesized
aagacagagaagccugauu

SEQ ID NO: 2517 - RNA, 19 nt, artificial
  Chemically synthesized
cagugucuugggaaugcag

SEQ ID NO: 2518 - RNA, 19 nt, artificial
  Chemically synthesized
uuccaaacauuccacggaa

SEQ ID NO: 2519 - RNA, 19 nt, artificial
  Chemically synthesized
caggcugaauuuuucaagu

SEQ ID NO: 2520 - RNA, 19 nt, artificial
  Chemically synthesized
aagaaucuuccucuauugu

SEQ ID NO: 2521 - RNA, 19 nt, artificial
  Chemically synthesized
guacagucaucaaacucua

SEQ ID NO: 2522 - RNA, 19 nt, artificial
  Chemically synthesized
cacagcacaugccagacac

SEQ ID NO: 2523 - RNA, 19 nt, artificial
  Chemically synthesized
gagucaaguugcuccuuag

SEQ ID NO: 2524 - RNA, 19 nt, artificial
  Chemically synthesized
ccacucacucuucacaaag

SEQ ID NO: 2525 - RNA, 19 nt, artificial
  Chemically synthesized
cugggcuuccuuuuggccu

SEQ ID NO: 2526 - RNA, 19 nt, artificial
  Chemically synthesized
agugaagguguccauauuu

SEQ ID NO: 2527 - RNA, 19 nt, artificial
  Chemically synthesized
uuccucaaggaagguaagu

SEQ ID NO: 2528 - RNA, 19 nt, artificial
  Chemically synthesized
ccaccagcuuccaaagucu

SEQ ID NO: 2529 - RNA, 19 nt, artificial
  Chemically synthesized
agguaaguccagcaaaauc

SEQ ID NO: 2530 - RNA, 19 nt, artificial
  Chemically synthesized
cauuaaggguacagucauc

SEQ ID NO: 2531 - RNA, 19 nt, artificial
  Chemically synthesized
acgcacaugggauggagag

SEQ ID NO: 2532 - RNA, 19 nt, artificial
  Chemically synthesized
ugccagacaccagugcugu

SEQ ID NO: 2533 - RNA, 19 nt, artificial
  Chemically synthesized
agagggaggcaucugguag

SEQ ID NO: 2534 - RNA, 19 nt, artificial
  Chemically synthesized
aguccaguucauacuugca

SEQ ID NO: 2535 - RNA, 19 nt, artificial
  Chemically synthesized
gaaagcacaaagacaguuu

SEQ ID NO: 2536 - RNA, 19 nt, artificial
  Chemically synthesized
cuuggagaggcugaugaug

SEQ ID NO: 2537 - RNA, 19 nt, artificial
  Chemically synthesized
gcagcaucauuguucucau

SEQ ID NO: 2538 - RNA, 19 nt, artificial
  Chemically synthesized
uuguaaggauuucccagua

SEQ ID NO: 2539 - RNA, 19 nt, artificial
  Chemically synthesized
ccagggaagaaaaagaauc

SEQ ID NO: 2540 - RNA, 19 nt, artificial
  Chemically synthesized
ccugggcuuccuuuuggcc

SEQ ID NO: 2541 - RNA, 19 nt, artificial
  Chemically synthesized
aggaucagaugacuuacau

SEQ ID NO: 2542 - RNA, 19 nt, artificial
  Chemically synthesized
acaugggauggagagucac

SEQ ID NO: 2543 - RNA, 19 nt, artificial
  Chemically synthesized
cuuccuuggagaggcugau

SEQ ID NO: 2544 - RNA, 19 nt, artificial
  Chemically synthesized
cuaauguaggugauccugu

SEQ ID NO: 2545 - RNA, 19 nt, artificial
  Chemically synthesized
uauugccaccagcuuccaa

SEQ ID NO: 2546 - RNA, 19 nt, artificial
  Chemically synthesized
ggccacuccagguaggucu

SEQ ID NO: 2547 - RNA, 19 nt, artificial
  Chemically synthesized
cuauaacucugucauuauc

SEQ ID NO: 2548 - RNA, 19 nt, artificial
  Chemically synthesized
caguucauacuugcaccac

SEQ ID NO: 2549 - RNA, 19 nt, artificial
  Chemically synthesized
aaaaaucuccagcaguaaa

SEQ ID NO: 2550 - RNA, 19 nt, artificial
  Chemically synthesized
cuugcaccacucacucuuc

SEQ ID NO: 2551 - RNA, 19 nt, artificial
  Chemically synthesized
cuaauucuaacaauccaga

SEQ ID NO: 2552 - RNA, 19 nt, artificial
  Chemically synthesized
ggagaaguccaguucauac

SEQ ID NO: 2553 - RNA, 19 nt, artificial
  Chemically synthesized
cuuuacuguuuucuacugu

SEQ ID NO: 2554 - RNA, 19 nt, artificial
  Chemically synthesized
gcacaugggauggagaguc

SEQ ID NO: 2555 - RNA, 19 nt, artificial
  Chemically synthesized
ugaguugcggcaaauucaa

SEQ ID NO: 2556 - RNA, 19 nt, artificial
  Chemically synthesized
caccaguggauaguucuga

SEQ ID NO: 2557 - RNA, 19 nt, artificial
  Chemically synthesized
ggaggauucuuccuuggag

SEQ ID NO: 2558 - RNA, 19 nt, artificial
  Chemically synthesized
auccuguuguuggacaggu

SEQ ID NO: 2559 - RNA, 19 nt, artificial
  Chemically synthesized
cuccagguaggucuuggug

SEQ ID NO: 2560 - RNA, 19 nt, artificial
  Chemically synthesized
ucucagauuuacccaaaau

SEQ ID NO: 2561 - RNA, 19 nt, artificial
  Chemically synthesized
aauaugcagccuccggauu

SEQ ID NO: 2562 - RNA, 19 nt, artificial
  Chemically synthesized
ccgcuuaugaagacacaac

SEQ ID NO: 2563 - RNA, 19 nt, artificial
  Chemically synthesized
gcaguuccaaacauuccac

SEQ ID NO: 2564 - RNA, 19 nt, artificial
  Chemically synthesized
agagucacacagguaauuu

SEQ ID NO: 2565 - RNA, 19 nt, artificial
  Chemically synthesized
gcucauagcucuguagauc

SEQ ID NO: 2566 - RNA, 19 nt, artificial
  Chemically synthesized
acagagaagccugauugga

SEQ ID NO: 2567 - RNA, 19 nt, artificial
  Chemically synthesized
agaauggcagcaucauugu

SEQ ID NO: 2568 - RNA, 19 nt, artificial
  Chemically synthesized
cacuguguauucgugugcu

SEQ ID NO: 2569 - RNA, 19 nt, artificial
  Chemically synthesized
aggucacuguugcuaaugu

SEQ ID NO: 2570 - RNA, 19 nt, artificial
  Chemically synthesized
agccugauuggaggauucu

SEQ ID NO: 2571 - RNA, 19 nt, artificial
  Chemically synthesized
acuuuggccagugcuugcu

SEQ ID NO: 2572 - RNA, 19 nt, artificial
  Chemically synthesized
uguauucgugugcuggaua

SEQ ID NO: 2573 - RNA, 19 nt, artificial
  Chemically synthesized
aauggaguuuaaagauccu

SEQ ID NO: 2574 - RNA, 19 nt, artificial
  Chemically synthesized
guagaucugaagcaucaau

SEQ ID NO: 2575 - RNA, 19 nt, artificial
  Chemically synthesized
cacuguugcuaauguaggu

SEQ ID NO: 2576 - RNA, 19 nt, artificial
  Chemically synthesized
cuguagaucugaagcauca

SEQ ID NO: 2577 - RNA, 19 nt, artificial
  Chemically synthesized
aaguuccucaaggaaggua

SEQ ID NO: 2578 - RNA, 19 nt, artificial
  Chemically synthesized
cagcaaaaucuuuucuuug

SEQ ID NO: 2579 - RNA, 19 nt, artificial
  Chemically synthesized
gguguucauuaucuuccgc

SEQ ID NO: 2580 - RNA, 19 nt, artificial
  Chemically synthesized
caaggaaccagaaaaacuu

SEQ ID NO: 2581 - RNA, 19 nt, artificial
  Chemically synthesized
uguagaucugaagcaucaa

SEQ ID NO: 2582 - RNA, 19 nt, artificial
  Chemically synthesized
cugugauucuuuuaacucu

SEQ ID NO: 2583 - RNA, 19 nt, artificial
  Chemically synthesized
agcuugcagaagcgcuggg

SEQ ID NO: 2584 - RNA, 19 nt, artificial
  Chemically synthesized
gauccugagcugcccuugc

SEQ ID NO: 2585 - RNA, 19 nt, artificial
  Chemically synthesized
aaguuuucagaaagcacaa

SEQ ID NO: 2586 - RNA, 19 nt, artificial
  Chemically synthesized
aggaacagagcacagcaca

SEQ ID NO: 2587 - RNA, 19 nt, artificial
  Chemically synthesized
cagccuguuacacugugua

SEQ ID NO: 2588 - RNA, 19 nt, artificial
  Chemically synthesized
aggguacagucaucaaacu

SEQ ID NO: 2589 - RNA, 19 nt, artificial
  Chemically synthesized
uguguauucgugugcugga

SEQ ID NO: 2590 - RNA, 19 nt, artificial
  Chemically synthesized
acagguaauuugcuggcca

SEQ ID NO: 2591 - RNA, 19 nt, artificial
  Chemically synthesized
aucggugauuuucacauuu

SEQ ID NO: 2592 - RNA, 19 nt, artificial
  Chemically synthesized
uguaggugauccuguuguu

SEQ ID NO: 2593 - RNA, 19 nt, artificial
  Chemically synthesized
cuaguaacauggguaagag

SEQ ID NO: 2594 - RNA, 19 nt, artificial
  Chemically synthesized
gaaaguaaacaaggaacca

SEQ ID NO: 2595 - RNA, 19 nt, artificial
  Chemically synthesized
gggaauggcuuuuuucuca

SEQ ID NO: 2596 - RNA, 19 nt, artificial
  Chemically synthesized
ccucuguaggucacuguug

SEQ ID NO: 2597 - RNA, 19 nt, artificial
  Chemically synthesized
gguagagucaucaacuuau

SEQ ID NO: 2598 - RNA, 19 nt, artificial
  Chemically synthesized
aucccgcucacuguaagaa

SEQ ID NO: 2599 - RNA, 19 nt, artificial
  Chemically synthesized
guugcuaauguaggugauc

SEQ ID NO: 2600 - RNA, 19 nt, artificial
  Chemically synthesized
gcacaaagacaguuuugug

SEQ ID NO: 2601 - RNA, 19 nt, artificial
  Chemically synthesized
caaucucaaguuccucaag

SEQ ID NO: 2602 - RNA, 19 nt, artificial
  Chemically synthesized
gaggauucuuccuuggaga

SEQ ID NO: 2603 - RNA, 19 nt, artificial
  Chemically synthesized
auccucacaggcugaauuu

SEQ ID NO: 2604 - RNA, 19 nt, artificial
  Chemically synthesized
ggcagcaucauuguucuca

SEQ ID NO: 2605 - RNA, 19 nt, artificial
  Chemically synthesized
cuuuaucgcagcucucaga

SEQ ID NO: 2606 - RNA, 19 nt, artificial
  Chemically synthesized
agaugagaaaaaagagaug

SEQ ID NO: 2607 - RNA, 19 nt, artificial
  Chemically synthesized
gugaagguguccauauuuc

SEQ ID NO: 2608 - RNA, 19 nt, artificial
  Chemically synthesized
gagggaauggaguuuaaag

SEQ ID NO: 2609 - RNA, 19 nt, artificial
  Chemically synthesized
uugcggcaaauucaaagaa

SEQ ID NO: 2610 - RNA, 19 nt, artificial
  Chemically synthesized
ucaaugggcuccagaagaa

SEQ ID NO: 2611 - RNA, 19 nt, artificial
  Chemically synthesized
cagcucucagauuuaccca

SEQ ID NO: 2612 - RNA, 19 nt, artificial
  Chemically synthesized
gaauuuguuucaccagugg

SEQ ID NO: 2613 - RNA, 19 nt, artificial
  Chemically synthesized
ccacccaguaggcaucccg

SEQ ID NO: 2614 - RNA, 19 nt, artificial
  Chemically synthesized
caucuacaaaaaucuccag

SEQ ID NO: 2615 - RNA, 19 nt, artificial
  Chemically synthesized
aguaaaauaugcugcuuca

SEQ ID NO: 2616 - RNA, 19 nt, artificial
  Chemically synthesized
ucuuugaguugcggcaaau

SEQ ID NO: 2617 - RNA, 19 nt, artificial
  Chemically synthesized
cuccuggaccauaagguuc

SEQ ID NO: 2618 - RNA, 19 nt, artificial
  Chemically synthesized
ugggagaaguccaguucau

SEQ ID NO: 2619 - RNA, 19 nt, artificial
  Chemically synthesized
aaagacggaaaugggagaa

SEQ ID NO: 2620 - RNA, 19 nt, artificial
  Chemically synthesized
accucuguaggucacuguu

SEQ ID NO: 2621 - RNA, 19 nt, artificial
  Chemically synthesized
accaguggauaguucugaa

SEQ ID NO: 2622 - RNA, 19 nt, artificial
  Chemically synthesized
guagagucaucaacuuauu

SEQ ID NO: 2623 - RNA, 19 nt, artificial
  Chemically synthesized
agcacagcacaugccagac

SEQ ID NO: 2624 - RNA, 19 nt, artificial
  Chemically synthesized
gcucuguagaucugaagca

SEQ ID NO: 2625 - RNA, 19 nt, artificial
  Chemically synthesized
auccacuugccaggaauga

SEQ ID NO: 2626 - RNA, 19 nt, artificial
  Chemically synthesized
aagauccugagcugcccuu

SEQ ID NO: 2627 - RNA, 19 nt, artificial
  Chemically synthesized
ugacaaguuucaggcauag

SEQ ID NO: 2628 - RNA, 19 nt, artificial
  Chemically synthesized
cagaugacuuacauucuga

SEQ ID NO: 2629 - RNA, 19 nt, artificial
  Chemically synthesized
ggaauggaguuuaaagauc

SEQ ID NO: 2630 - RNA, 19 nt, artificial
  Chemically synthesized
ggaauaugcagccuccgga

SEQ ID NO: 2631 - RNA, 19 nt, artificial
  Chemically synthesized
gccuguuacacuguguauu

SEQ ID NO: 2632 - RNA, 19 nt, artificial
  Chemically synthesized
uguagagagggccaggcau

SEQ ID NO: 2633 - RNA, 19 nt, artificial
  Chemically synthesized
cauagcucuguagaucuga

SEQ ID NO: 2634 - RNA, 19 nt, artificial
  Chemically synthesized
uucuuugaguugcggcaaa

SEQ ID NO: 2635 - RNA, 19 nt, artificial
  Chemically synthesized
cucaaggaagguaagucca

SEQ ID NO: 2636 - RNA, 19 nt, artificial
  Chemically synthesized
uccaugggccacuccaggu

SEQ ID NO: 2637 - RNA, 19 nt, artificial
  Chemically synthesized
agccuguuacacuguguau

SEQ ID NO: 2638 - RNA, 19 nt, artificial
  Chemically synthesized
cacuugccaggaaugaagu

SEQ ID NO: 2639 - RNA, 19 nt, artificial
  Chemically synthesized
ucccaguaaguuuaagaau

SEQ ID NO: 2640 - RNA, 19 nt, artificial
  Chemically synthesized
cuucaaacuuuuuggcuca

SEQ ID NO: 2641 - RNA, 19 nt, artificial
  Chemically synthesized
cacaaaguuuucagaaagc

SEQ ID NO: 2642 - RNA, 19 nt, artificial
  Chemically synthesized
gccaggaaugaagucccgc

SEQ ID NO: 2643 - RNA, 19 nt, artificial
  Chemically synthesized
gaugagaaaaaagagaugu

SEQ ID NO: 2644 - RNA, 19 nt, artificial
  Chemically synthesized
aaacaaggaaccagaaaaa

SEQ ID NO: 2645 - RNA, 19 nt, artificial
  Chemically synthesized
ggagcuuuccugggcuucc

SEQ ID NO: 2646 - RNA, 19 nt, artificial
  Chemically synthesized
auggagagucacacaggua

SEQ ID NO: 2647 - RNA, 19 nt, artificial
  Chemically synthesized
accagaaaaacuuuacugu

SEQ ID NO: 2648 - RNA, 19 nt, artificial
  Chemically synthesized
uucaaacuuuuuggcucau

SEQ ID NO: 2649 - RNA, 19 nt, artificial
  Chemically synthesized
ggauaagucuaaauguuca

SEQ ID NO: 2650 - RNA, 19 nt, artificial
  Chemically synthesized
guuuuguggcucuuuucaa

SEQ ID NO: 2651 - RNA, 19 nt, artificial
  Chemically synthesized
gaugacuuacauucugaau

SEQ ID NO: 2652 - RNA, 19 nt, artificial
  Chemically synthesized
uggccacgcacaugggaug

SEQ ID NO: 2653 - RNA, 19 nt, artificial
  Chemically synthesized
aaguuauugccaccagcuu

SEQ ID NO: 2654 - RNA, 19 nt, artificial
  Chemically synthesized
cgcaguuccaaacauucca

SEQ ID NO: 2655 - RNA, 19 nt, artificial
  Chemically synthesized
agaggcggacauccugaac

SEQ ID NO: 2656 - RNA, 19 nt, artificial
  Chemically synthesized
cugaaaaauggaaaguguc

SEQ ID NO: 2657 - RNA, 19 nt, artificial
  Chemically synthesized
gauaguucugaaaaaugga

SEQ ID NO: 2658 - RNA, 19 nt, artificial
  Chemically synthesized
aaaagacggaaaugggaga

SEQ ID NO: 2659 - RNA, 19 nt, artificial
  Chemically synthesized
cugaagcaucaaucucaag

SEQ ID NO: 2660 - RNA, 19 nt, artificial
  Chemically synthesized
guaauuugcuggccaauca

SEQ ID NO: 2661 - RNA, 19 nt, artificial
  Chemically synthesized
ugcccagggaagaaaaaga

SEQ ID NO: 2662 - RNA, 19 nt, artificial
  Chemically synthesized
aggguuuuguaaggauuuc

SEQ ID NO: 2663 - RNA, 19 nt, artificial
  Chemically synthesized
cauaugaaggaucagauga

SEQ ID NO: 2664 - RNA, 19 nt, artificial
  Chemically synthesized
ugggauggagagucacaca

SEQ ID NO: 2665 - RNA, 19 nt, artificial
  Chemically synthesized
cccgcucacuguaagaaac

SEQ ID NO: 2666 - RNA, 19 nt, artificial
  Chemically synthesized
acuaguaacauggguaaga

SEQ ID NO: 2667 - RNA, 19 nt, artificial
  Chemically synthesized
ucucaucaaaaagacggaa

SEQ ID NO: 2668 - RNA, 19 nt, artificial
  Chemically synthesized
ggaucuauaacucugucau

SEQ ID NO: 2669 - RNA, 19 nt, artificial
  Chemically synthesized
cuccagcaguaaaauaugc

SEQ ID NO: 2670 - RNA, 19 nt, artificial
  Chemically synthesized
ggaaaugggagaaguccag

SEQ ID NO: 2671 - RNA, 19 nt, artificial
  Chemically synthesized
cauccucacaggcugaauu

SEQ ID NO: 2672 - RNA, 19 nt, artificial
  Chemically synthesized
gaauaugcagccuccggau

SEQ ID NO: 2673 - RNA, 19 nt, artificial
  Chemically synthesized
caagacccacaccauccac

SEQ ID NO: 2674 - RNA, 19 nt, artificial
  Chemically synthesized
agucccgcuuaugaagaca

SEQ ID NO: 2675 - RNA, 19 nt, artificial
  Chemically synthesized
augggccacuccagguagg

SEQ ID NO: 2676 - RNA, 19 nt, artificial
  Chemically synthesized
cauuccuacugauuuucaa

SEQ ID NO: 2677 - RNA, 19 nt, artificial
  Chemically synthesized
guaggugauccuguuguug

SEQ ID NO: 2678 - RNA, 19 nt, artificial
  Chemically synthesized
caaagacaguuuuguggcu

SEQ ID NO: 2679 - RNA, 19 nt, artificial
  Chemically synthesized
gagucaaugauauugucaa

SEQ ID NO: 2680 - RNA, 19 nt, artificial
  Chemically synthesized
gaaacaaacuuucaucggu

SEQ ID NO: 2681 - RNA, 19 nt, artificial
  Chemically synthesized
cacaugccagacaccagug

SEQ ID NO: 2682 - RNA, 19 nt, artificial
  Chemically synthesized
gauccacuugccaggaaug

SEQ ID NO: 2683 - RNA, 19 nt, artificial
  Chemically synthesized
acaaaaaucuccagcagua

SEQ ID NO: 2684 - RNA, 19 nt, artificial
  Chemically synthesized
auccacaaaguauguggca

SEQ ID NO: 2685 - RNA, 19 nt, artificial
  Chemically synthesized
gugagaugagaaaaaagag

SEQ ID NO: 2686 - RNA, 19 nt, artificial
  Chemically synthesized
ggauucuuccuuggagagg

SEQ ID NO: 2687 - RNA, 19 nt, artificial
  Chemically synthesized
ucuuccgcagcuugcagaa

SEQ ID NO: 2688 - RNA, 19 nt, artificial
  Chemically synthesized
agucaaguugcuccuuaga

SEQ ID NO: 2689 - RNA, 19 nt, artificial
  Chemically synthesized
ugcuggccacgcacauggg

SEQ ID NO: 2690 - RNA, 19 nt, artificial
  Chemically synthesized
cacagguaauuugcuggcc

SEQ ID NO: 2691 - RNA, 19 nt, artificial
  Chemically synthesized
ucccgcuuaugaagacaca

SEQ ID NO: 2692 - RNA, 19 nt, artificial
  Chemically synthesized
agcucucagauuuacccaa

SEQ ID NO: 2693 - RNA, 19 nt, artificial
  Chemically synthesized
gucacacagguaauuugcu

SEQ ID NO: 2694 - RNA, 19 nt, artificial
  Chemically synthesized
ucccgcucacuguaagaaa

SEQ ID NO: 2695 - RNA, 19 nt, artificial
  Chemically synthesized
gacggaaaugggagaaguc

SEQ ID NO: 2696 - RNA, 19 nt, artificial
  Chemically synthesized
agcuuuccugggcuuccuu

SEQ ID NO: 2697 - RNA, 19 nt, artificial
  Chemically synthesized
ccaacuccauuaaggguac

SEQ ID NO: 2698 - RNA, 19 nt, artificial
  Chemically synthesized
cggugauuuucacauuucu

SEQ ID NO: 2699 - RNA, 19 nt, artificial
  Chemically synthesized
gggaagaaaaagaaucuuc

SEQ ID NO: 2700 - RNA, 19 nt, artificial
  Chemically synthesized
guggcucuuuucaauggag

SEQ ID NO: 2701 - RNA, 19 nt, artificial
  Chemically synthesized
cccaguaaguuuaagaaug

SEQ ID NO: 2702 - RNA, 19 nt, artificial
  Chemically synthesized
cucuguagaucugaagcau

SEQ ID NO: 2703 - RNA, 19 nt, artificial
  Chemically synthesized
cuuagugaagguguccaua

SEQ ID NO: 2704 - RNA, 19 nt, artificial
  Chemically synthesized
agcaggaucagcaggaaca

SEQ ID NO: 2705 - RNA, 19 nt, artificial
  Chemically synthesized
cacccaguaggcaucccgc

SEQ ID NO: 2706 - RNA, 19 nt, artificial
  Chemically synthesized
cacaccauccacaaaguau

SEQ ID NO: 2707 - RNA, 19 nt, artificial
  Chemically synthesized
aagguaaguccagcaaaau

SEQ ID NO: 2708 - RNA, 19 nt, artificial
  Chemically synthesized
ugcggcaaauucaaagaaa

SEQ ID NO: 2709 - RNA, 19 nt, artificial
  Chemically synthesized
gcaucaaucucaaguuccu

SEQ ID NO: 2710 - RNA, 19 nt, artificial
  Chemically synthesized
gagaugagaaaaaagagau

SEQ ID NO: 2711 - RNA, 19 nt, artificial
  Chemically synthesized
ccagugucuugggaaugca

SEQ ID NO: 2712 - RNA, 19 nt, artificial
  Chemically synthesized
ccaaaucaguaucucgcag

SEQ ID NO: 2713 - RNA, 19 nt, artificial
  Chemically synthesized
ggagcaaaugaaguuauug

SEQ ID NO: 2714 - RNA, 19 nt, artificial
  Chemically synthesized
uccacaaaguauguggcau

SEQ ID NO: 2715 - RNA, 19 nt, artificial
  Chemically synthesized
acccaguaggcaucccgcu

SEQ ID NO: 2716 - RNA, 19 nt, artificial
  Chemically synthesized
cuguaggucacuguugcua

SEQ ID NO: 2717 - RNA, 19 nt, artificial
  Chemically synthesized
gcucacuguaagaaacaaa

SEQ ID NO: 2718 - RNA, 19 nt, artificial
  Chemically synthesized
cuucacaaaguuuucagaa

SEQ ID NO: 2719 - RNA, 19 nt, artificial
  Chemically synthesized
cugaauugacuucaaacuu

SEQ ID NO: 2720 - RNA, 19 nt, artificial
  Chemically synthesized
ugcagccuccggauuguua

SEQ ID NO: 2721 - RNA, 19 nt, artificial
  Chemically synthesized
uggaaacgguggcacagga

SEQ ID NO: 2722 - RNA, 19 nt, artificial
  Chemically synthesized
cuacaaaaaucuccagcag

SEQ ID NO: 2723 - RNA, 19 nt, artificial
  Chemically synthesized
aggcggacauccugaaccu

SEQ ID NO: 2724 - RNA, 19 nt, artificial
  Chemically synthesized
uccagcuccuggaccauaa

SEQ ID NO: 2725 - RNA, 19 nt, artificial
  Chemically synthesized
cuggaucuauaacucuguc

SEQ ID NO: 2726 - RNA, 19 nt, artificial
  Chemically synthesized
guagagagggccaggcauc

SEQ ID NO: 2727 - RNA, 19 nt, artificial
  Chemically synthesized
caggaacagagcacagcac

SEQ ID NO: 2728 - RNA, 19 nt, artificial
  Chemically synthesized
cggaaaugggagaagucca

SEQ ID NO: 2729 - RNA, 19 nt, artificial
  Chemically synthesized
uccuuuuggccuggagcca

SEQ ID NO: 2730 - RNA, 19 nt, artificial
  Chemically synthesized
acaaacuuucaucggugau

SEQ ID NO: 2731 - RNA, 19 nt, artificial
  Chemically synthesized
cucuaauucuaacaaucca

SEQ ID NO: 2732 - RNA, 19 nt, artificial
  Chemically synthesized
ccauaagguucuccaccca

SEQ ID NO: 2733 - RNA, 19 nt, artificial
  Chemically synthesized
gucaaguugcuccuuagaa

SEQ ID NO: 2734 - RNA, 19 nt, artificial
  Chemically synthesized
gaauggcuuuuuucucaau

SEQ ID NO: 2735 - RNA, 19 nt, artificial
  Chemically synthesized
gccaccagcuuccaaaguc

SEQ ID NO: 2736 - RNA, 19 nt, artificial
  Chemically synthesized
uggagagucacacagguaa

SEQ ID NO: 2737 - RNA, 19 nt, artificial
  Chemically synthesized
gagaaaaaagagauguuuc

SEQ ID NO: 2738 - RNA, 19 nt, artificial
  Chemically synthesized
ugugcuggauaaguucaaa

SEQ ID NO: 2739 - RNA, 19 nt, artificial
  Chemically synthesized
guucuccacccaguaggca

SEQ ID NO: 2740 - RNA, 19 nt, artificial
  Chemically synthesized
gugcuggauaaguucaaau

SEQ ID NO: 2741 - RNA, 19 nt, artificial
  Chemically synthesized
cauuccacggaacuuguaa

SEQ ID NO: 2742 - RNA, 19 nt, artificial
  Chemically synthesized
acaagacagagaagccuga

SEQ ID NO: 2743 - RNA, 19 nt, artificial
  Chemically synthesized
cgcagcuugcagaagcgcu

SEQ ID NO: 2744 - RNA, 19 nt, artificial
  Chemically synthesized
acaggagcaaaugaaguua

SEQ ID NO: 2745 - RNA, 19 nt, artificial
  Chemically synthesized
gaagccugauuggaggauu

SEQ ID NO: 2746 - RNA, 19 nt, artificial
  Chemically synthesized
gcagccuguuacacugugu

SEQ ID NO: 2747 - RNA, 19 nt, artificial
  Chemically synthesized
ggacuuuaucgcagcucuc

SEQ ID NO: 2748 - RNA, 19 nt, artificial
  Chemically synthesized
ucuuuucaauggagucaau

SEQ ID NO: 2749 - RNA, 19 nt, artificial
  Chemically synthesized
cagcuccuggaccauaagg

SEQ ID NO: 2750 - RNA, 19 nt, artificial
  Chemically synthesized
gcagcuugcagaagcgcug

SEQ ID NO: 2751 - RNA, 19 nt, artificial
  Chemically synthesized
gaaaugggagaaguccagu

SEQ ID NO: 2752 - RNA, 19 nt, artificial
  Chemically synthesized
ggaaugcagccuguuacac

SEQ ID NO: 2753 - RNA, 19 nt, artificial
  Chemically synthesized
aggaauucacaggagcaaa

SEQ ID NO: 2754 - RNA, 19 nt, artificial
  Chemically synthesized
ccaaacauuccacggaacu

SEQ ID NO: 2755 - RNA, 19 nt, artificial
  Chemically synthesized
caggcauccucacaggcug

SEQ ID NO: 2756 - RNA, 19 nt, artificial
  Chemically synthesized
cucaaugggcuccagaaga

SEQ ID NO: 2757 - RNA, 19 nt, artificial
  Chemically synthesized
agacccacaccauccacaa

SEQ ID NO: 2758 - RNA, 19 nt, artificial
  Chemically synthesized
ccucacaggcugaauuuuu

SEQ ID NO: 2759 - RNA, 19 nt, artificial
  Chemically synthesized
gcaaaugaaguuauugcca

SEQ ID NO: 2760 - RNA, 19 nt, artificial
  Chemically synthesized
cagcacaugccagacacca

SEQ ID NO: 2761 - RNA, 19 nt, artificial
  Chemically synthesized
ccagcaguaaaauaugcug

SEQ ID NO: 2762 - RNA, 19 nt, artificial
  Chemically synthesized
cuuuucuggccacugacaa

SEQ ID NO: 2763 - RNA, 19 nt, artificial
  Chemically synthesized
ugagggaauggaguuuaaa

SEQ ID NO: 2764 - RNA, 19 nt, artificial
  Chemically synthesized
ggauggagagucacacagg

SEQ ID NO: 2765 - RNA, 19 nt, artificial
  Chemically synthesized
uggccagugcuugcugcuc

SEQ ID NO: 2766 - RNA, 19 nt, artificial
  Chemically synthesized
gagcuuuccugggcuuccu

SEQ ID NO: 2767 - RNA, 19 nt, artificial
  Chemically synthesized
ggcucuuuucaauggaguc

SEQ ID NO: 2768 - RNA, 19 nt, artificial
  Chemically synthesized
ucucaaguuccucaaggaa

SEQ ID NO: 2769 - RNA, 19 nt, artificial
  Chemically synthesized
acauuccacggaacuugua

SEQ ID NO: 2770 - RNA, 19 nt, artificial
  Chemically synthesized
aacuuucaucggugauuuu

SEQ ID NO: 2771 - RNA, 19 nt, artificial
  Chemically synthesized
ggagucaaugauauuguca

SEQ ID NO: 2772 - RNA, 19 nt, artificial
  Chemically synthesized
cagguaggucuugguguuc

SEQ ID NO: 2773 - RNA, 19 nt, artificial
  Chemically synthesized
guugcggcaaauucaaaga

SEQ ID NO: 2774 - RNA, 19 nt, artificial
  Chemically synthesized
aacaaacuuucaucgguga

SEQ ID NO: 2775 - RNA, 19 nt, artificial
  Chemically synthesized
gacuuuaucgcagcucuca

SEQ ID NO: 2776 - RNA, 19 nt, artificial
  Chemically synthesized
cagagcacagcacaugcca

SEQ ID NO: 2777 - RNA, 19 nt, artificial
  Chemically synthesized
gcacaugccagacaccagu

SEQ ID NO: 2778 - RNA, 19 nt, artificial
  Chemically synthesized
gaagucccgcuuaugaaga

SEQ ID NO: 2779 - RNA, 19 nt, artificial
  Chemically synthesized
caaugggcuccagaagaau

SEQ ID NO: 2780 - RNA, 19 nt, artificial
  Chemically synthesized
uccucacaggcugaauuuu

SEQ ID NO: 2781 - RNA, 19 nt, artificial
  Chemically synthesized
cuguugcuaauguagguga

SEQ ID NO: 2782 - RNA, 19 nt, artificial
  Chemically synthesized
guccaugggccacuccagg

SEQ ID NO: 2783 - RNA, 19 nt, artificial
  Chemically synthesized
guuccaaacauuccacgga

SEQ ID NO: 2784 - RNA, 19 nt, artificial
  Chemically synthesized
ugggccacuccagguaggu

SEQ ID NO: 2785 - RNA, 19 nt, artificial
  Chemically synthesized
caaguugcuccuuagaaaa

SEQ ID NO: 2786 - RNA, 19 nt, artificial
  Chemically synthesized
cucacucuucacaaaguuu

SEQ ID NO: 2787 - RNA, 19 nt, artificial
  Chemically synthesized
agaagccugauuggaggau

SEQ ID NO: 2788 - RNA, 19 nt, artificial
  Chemically synthesized
aggcugaauuuuucaagua

SEQ ID NO: 2789 - RNA, 19 nt, artificial
  Chemically synthesized
ccaguucauacuugcacca

SEQ ID NO: 2790 - RNA, 19 nt, artificial
  Chemically synthesized
caggaaugaagucccgcuu

SEQ ID NO: 2791 - RNA, 19 nt, artificial
  Chemically synthesized
ggugauuuucacauuucua

SEQ ID NO: 2792 - RNA, 19 nt, artificial
  Chemically synthesized
cauucugaauugacuucaa

SEQ ID NO: 2793 - RNA, 19 nt, artificial
  Chemically synthesized
guuagucaaguuuuucaga

SEQ ID NO: 2794 - RNA, 19 nt, artificial
  Chemically synthesized
guaggucuugguguucauu

SEQ ID NO: 2795 - RNA, 19 nt, artificial
  Chemically synthesized
gguaauuugcuggccaauc

SEQ ID NO: 2796 - RNA, 19 nt, artificial
  Chemically synthesized
guucugaaaaauggaaagu

SEQ ID NO: 2797 - RNA, 19 nt, artificial
  Chemically synthesized
ccuggaucuauaacucugu

SEQ ID NO: 2798 - RNA, 19 nt, artificial
  Chemically synthesized
gacagagaagccugauugg

SEQ ID NO: 2799 - RNA, 19 nt, artificial
  Chemically synthesized
ucuccagcuccuggaccau

SEQ ID NO: 2800 - RNA, 19 nt, artificial
  Chemically synthesized
aguaaacaaggaaccagaa

SEQ ID NO: 2801 - RNA, 19 nt, artificial
  Chemically synthesized
gucaaugauccacuugcca

SEQ ID NO: 2802 - RNA, 19 nt, artificial
  Chemically synthesized
gagauccaaguauucuaau

SEQ ID NO: 2803 - RNA, 19 nt, artificial
  Chemically synthesized
gcaucccgcucacuguaag

SEQ ID NO: 2804 - RNA, 19 nt, artificial
  Chemically synthesized
caccacucacucuucacaa

SEQ ID NO: 2805 - RNA, 19 nt, artificial
  Chemically synthesized
agacaguuuuguggcucuu

SEQ ID NO: 2806 - RNA, 19 nt, artificial
  Chemically synthesized
ccuuuuggccuggagccag

SEQ ID NO: 2807 - RNA, 19 nt, artificial
  Chemically synthesized
cugcuccugagugaaggag

SEQ ID NO: 2808 - RNA, 19 nt, artificial
  Chemically synthesized
gcaucauuguucucaucaa

SEQ ID NO: 2809 - RNA, 19 nt, artificial
  Chemically synthesized
ggaucagcaggaacagagc

SEQ ID NO: 2810 - RNA, 19 nt, artificial
  Chemically synthesized
uggagccaggcccacauca

SEQ ID NO: 2811 - RNA, 19 nt, artificial
  Chemically synthesized
cuuuuggccuggagccagg

SEQ ID NO: 2812 - RNA, 19 nt, artificial
  Chemically synthesized
ggcaucugguagagucauc

SEQ ID NO: 2813 - RNA, 19 nt, artificial
  Chemically synthesized
cacucacucuucacaaagu

SEQ ID NO: 2814 - RNA, 19 nt, artificial
  Chemically synthesized
cuaaaauuuccagugucuu

SEQ ID NO: 2815 - RNA, 19 nt, artificial
  Chemically synthesized
ggaaacgguggcacaggac

SEQ ID NO: 2816 - RNA, 19 nt, artificial
  Chemically synthesized
guuuaaagauccugagcug

SEQ ID NO: 2817 - RNA, 19 nt, artificial
  Chemically synthesized
ggaauucacaggagcaaau

SEQ ID NO: 2818 - RNA, 19 nt, artificial
  Chemically synthesized
aguuuucagaaagcacaaa

SEQ ID NO: 2819 - RNA, 19 nt, artificial
  Chemically synthesized
augcagccuccggauuguu

SEQ ID NO: 2820 - RNA, 19 nt, artificial
  Chemically synthesized
aucgcagcucucagauuua

SEQ ID NO: 2821 - RNA, 19 nt, artificial
  Chemically synthesized
ccuuggagaggcugaugau

SEQ ID NO: 2822 - RNA, 19 nt, artificial
  Chemically synthesized
ggaauggcuuuuuucucaa

SEQ ID NO: 2823 - RNA, 19 nt, artificial
  Chemically synthesized
cagggaagaaaaagaaucu

SEQ ID NO: 2824 - RNA, 19 nt, artificial
  Chemically synthesized
caggagcaaaugaaguuau

SEQ ID NO: 2825 - RNA, 19 nt, artificial
  Chemically synthesized
agggaggcaucugguagag

SEQ ID NO: 2826 - RNA, 19 nt, artificial
  Chemically synthesized
caccagcuuccaaagucuu

SEQ ID NO: 2827 - RNA, 19 nt, artificial
  Chemically synthesized
ggaguuuaaagauccugag

SEQ ID NO: 2828 - RNA, 19 nt, artificial
  Chemically synthesized
ugccaccagcuuccaaagu

SEQ ID NO: 2829 - RNA, 19 nt, artificial
  Chemically synthesized
gcuuuccugggcuuccuuu

SEQ ID NO: 2830 - RNA, 19 nt, artificial
  Chemically synthesized
caaacauuccacggaacuu

SEQ ID NO: 2831 - RNA, 19 nt, artificial
  Chemically synthesized
aaggaaccagaaaaacuuu

SEQ ID NO: 2832 - RNA, 19 nt, artificial
  Chemically synthesized
caaaaagacggaaauggga

SEQ ID NO: 2833 - RNA, 19 nt, artificial
  Chemically synthesized
cuuuggccagugcuugcug

SEQ ID NO: 2834 - RNA, 19 nt, artificial
  Chemically synthesized
aguaggcaucccgcucacu

SEQ ID NO: 2835 - RNA, 19 nt, artificial
  Chemically synthesized
cacaggagcaaaugaaguu

SEQ ID NO: 2836 - RNA, 19 nt, artificial
  Chemically synthesized
caucugguagagucaucaa

SEQ ID NO: 2837 - RNA, 19 nt, artificial
  Chemically synthesized
caucccgcucacuguaaga

SEQ ID NO: 2838 - RNA, 19 nt, artificial
  Chemically synthesized
guuccucaaggaagguaag

SEQ ID NO: 2839 - RNA, 19 nt, artificial
  Chemically synthesized
caugggccacuccagguag

SEQ ID NO: 2840 - RNA, 19 nt, artificial
  Chemically synthesized
uguaaggauuucccaguaa

SEQ ID NO: 2841 - RNA, 19 nt, artificial
  Chemically synthesized
aggcaucugguagagucau

SEQ ID NO: 2842 - RNA, 19 nt, artificial
  Chemically synthesized
caagacagagaagccugau

SEQ ID NO: 2843 - RNA, 19 nt, artificial
  Chemically synthesized
aggaaugaagucccgcuua

SEQ ID NO: 2844 - RNA, 19 nt, artificial
  Chemically synthesized
cagcuugcagaagcgcugg

SEQ ID NO: 2845 - RNA, 19 nt, artificial
  Chemically synthesized
ggucacuguugcuaaugua

SEQ ID NO: 2846 - RNA, 19 nt, artificial
  Chemically synthesized
gaagaaaaagaaucuuccu

SEQ ID NO: 2847 - RNA, 19 nt, artificial
  Chemically synthesized
cacaggcugaauuuuucaa

SEQ ID NO: 2848 - RNA, 19 nt, artificial
  Chemically synthesized
gcaccacucacucuucaca

SEQ ID NO: 2849 - RNA, 19 nt, artificial
  Chemically synthesized
cuugggaaugcagccuguu

SEQ ID NO: 2850 - RNA, 19 nt, artificial
  Chemically synthesized
guuucaccaguggauaguu

SEQ ID NO: 2851 - RNA, 19 nt, artificial
  Chemically synthesized
guaaguccagcaaaaucuu

SEQ ID NO: 2852 - RNA, 19 nt, artificial
  Chemically synthesized
gcugcuucauaugaaggau

SEQ ID NO: 2853 - RNA, 19 nt, artificial
  Chemically synthesized
cuuccgcagcuugcagaag

SEQ ID NO: 2854 - RNA, 19 nt, artificial
  Chemically synthesized
gcuuccuuuuggccuggag

SEQ ID NO: 2855 - RNA, 19 nt, artificial
  Chemically synthesized
cgugugcuggauaaguuca

SEQ ID NO: 2856 - RNA, 19 nt, artificial
  Chemically synthesized
aagagggaggcaucuggua

SEQ ID NO: 2857 - RNA, 19 nt, artificial
  Chemically synthesized
caauggagucaaugauauu

SEQ ID NO: 2858 - RNA, 19 nt, artificial
  Chemically synthesized
gaggcaucugguagaguca

SEQ ID NO: 2859 - RNA, 19 nt, artificial
  Chemically synthesized
guuggacaggucaaggcuu

SEQ ID NO: 2860 - RNA, 19 nt, artificial
  Chemically synthesized
ggccagugcuugcugcucc

SEQ ID NO: 2861 - RNA, 19 nt, artificial
  Chemically synthesized
caucaaaaagacggaaaug

SEQ ID NO: 2862 - RNA, 19 nt, artificial
  Chemically synthesized
gcaauuuugugagaugaga

SEQ ID NO: 2863 - RNA, 19 nt, artificial
  Chemically synthesized
ccagguaggucuugguguu

SEQ ID NO: 2864 - RNA, 19 nt, artificial
  Chemically synthesized
ggaaccagaaaaacuuuac

SEQ ID NO: 2865 - RNA, 19 nt, artificial
  Chemically synthesized
gauggagagucacacaggu

SEQ ID NO: 2866 - RNA, 19 nt, artificial
  Chemically synthesized
ccacgcacaugggauggag

SEQ ID NO: 2867 - RNA, 19 nt, artificial
  Chemically synthesized
ccauuaaggguacagucau

SEQ ID NO: 2868 - RNA, 19 nt, artificial
  Chemically synthesized
guggauaguucugaaaaau

SEQ ID NO: 2869 - RNA, 19 nt, artificial
  Chemically synthesized
gaguuuaaagauccugagc

SEQ ID NO: 2870 - RNA, 19 nt, artificial
  Chemically synthesized
gcuuaugaagacacaacuu

SEQ ID NO: 2871 - RNA, 19 nt, artificial
  Chemically synthesized
cugguagagucaucaacuu

SEQ ID NO: 2872 - RNA, 19 nt, artificial
  Chemically synthesized
cacuuuaccuggaucuaua

SEQ ID NO: 2873 - RNA, 19 nt, artificial
  Chemically synthesized
cugggagcuuuccugggcu

SEQ ID NO: 2874 - RNA, 19 nt, artificial
  Chemically synthesized
gacaguuuuguggcucuuu

SEQ ID NO: 2875 - RNA, 19 nt, artificial
  Chemically synthesized
gugauccuguuguuggaca

SEQ ID NO: 2876 - RNA, 19 nt, artificial
  Chemically synthesized
gguaggucuugguguucau

SEQ ID NO: 2877 - RNA, 19 nt, artificial
  Chemically synthesized
cucuuuucaauggagucaa

SEQ ID NO: 2878 - RNA, 19 nt, artificial
  Chemically synthesized
guccagcaaaaucuuuucu

SEQ ID NO: 2879 - RNA, 19 nt, artificial
  Chemically synthesized
gagcacagcacaugccaga

SEQ ID NO: 2880 - RNA, 19 nt, artificial
  Chemically synthesized
caugggauggagagucaca

SEQ ID NO: 2881 - RNA, 19 nt, artificial
  Chemically synthesized
gggauggagagucacacag

SEQ ID NO: 2882 - RNA, 19 nt, artificial
  Chemically synthesized
gcuaauguaggugauccug

SEQ ID NO: 2883 - RNA, 19 nt, artificial
  Chemically synthesized
caacuccauuaaggguaca

SEQ ID NO: 2884 - RNA, 19 nt, artificial
  Chemically synthesized
augauccacuugccaggaa

SEQ ID NO: 2885 - RNA, 19 nt, artificial
  Chemically synthesized
gacuuuggccagugcuugc

SEQ ID NO: 2886 - RNA, 19 nt, artificial
  Chemically synthesized
ccaggcauccucacaggcu

SEQ ID NO: 2887 - RNA, 19 nt, artificial
  Chemically synthesized
gaucagcaggaacagagca

SEQ ID NO: 2888 - RNA, 19 nt, artificial
  Chemically synthesized
aggaagguaaguccagcaa

SEQ ID NO: 2889 - RNA, 19 nt, artificial
  Chemically synthesized
gcagccuccggauuguuaa

SEQ ID NO: 2890 - RNA, 19 nt, artificial
  Chemically synthesized
ccaguggauaguucugaaa

SEQ ID NO: 2891 - RNA, 19 nt, artificial
  Chemically synthesized
guaaacaaggaaccagaaa

SEQ ID NO: 2892 - RNA, 19 nt, artificial
  Chemically synthesized
accacucacucuucacaaa

SEQ ID NO: 2893 - RNA, 19 nt, artificial
  Chemically synthesized
gauccuguuguuggacagg

SEQ ID NO: 2894 - RNA, 19 nt, artificial
  Chemically synthesized
ccgcucacuguaagaaaca

SEQ ID NO: 2895 - RNA, 19 nt, artificial
  Chemically synthesized
guaaaauaugcugcuucau

SEQ ID NO: 2896 - RNA, 19 nt, artificial
  Chemically synthesized
ggugauccuguuguuggac

SEQ ID NO: 2897 - RNA, 19 nt, artificial
  Chemically synthesized
ccauuggaugucagcacca

SEQ ID NO: 2898 - RNA, 19 nt, artificial
  Chemically synthesized
cagaaagcacaaagacagu

SEQ ID NO: 2899 - RNA, 19 nt, artificial
  Chemically synthesized
uggacaggucaaggcuuuu

SEQ ID NO: 2900 - RNA, 19 nt, artificial
  Chemically synthesized
ggaucagaugacuuacauu

SEQ ID NO: 2901 - RNA, 19 nt, artificial
  Chemically synthesized
cugcccagggaagaaaaag

SEQ ID NO: 2902 - RNA, 19 nt, artificial
  Chemically synthesized
aggugauccuguuguugga

SEQ ID NO: 2903 - RNA, 19 nt, artificial
  Chemically synthesized
guaggucacuguugcuaau

SEQ ID NO: 2904 - RNA, 19 nt, artificial
  Chemically synthesized
cgagaggcggacauccuga

SEQ ID NO: 2905 - RNA, 19 nt, artificial
  Chemically synthesized
aucuuccucuauuguguua

SEQ ID NO: 2906 - RNA, 19 nt, artificial
  Chemically synthesized
cuuuaccuggaucuauaac

SEQ ID NO: 2907 - RNA, 19 nt, artificial
  Chemically synthesized
ccuggaccauaagguucuc

SEQ ID NO: 2908 - RNA, 19 nt, artificial
  Chemically synthesized
cuccacccaguaggcaucc

SEQ ID NO: 2909 - RNA, 19 nt, artificial
  Chemically synthesized
gcuucauaugaaggaucag

SEQ ID NO: 2910 - RNA, 19 nt, artificial
  Chemically synthesized
cuggccacgcacaugggau

SEQ ID NO: 2911 - RNA, 19 nt, artificial
  Chemically synthesized
caucggugauuuucacauu

SEQ ID NO: 2912 - RNA, 19 nt, artificial
  Chemically synthesized
guguauucgugugcuggau

SEQ ID NO: 2913 - RNA, 19 nt, artificial
  Chemically synthesized
aggcaucccgcucacugua

SEQ ID NO: 2914 - RNA, 19 nt, artificial
  Chemically synthesized
gacuuacauucugaauuga

SEQ ID NO: 2915 - RNA, 19 nt, artificial
  Chemically synthesized
aggagcaaaugaaguuauu

SEQ ID NO: 2916 - RNA, 19 nt, artificial
  Chemically synthesized
caguggauaguucugaaaa

SEQ ID NO: 2917 - RNA, 19 nt, artificial
  Chemically synthesized
aguggauaguucugaaaaa

SEQ ID NO: 2918 - RNA, 19 nt, artificial
  Chemically synthesized
gugagcaggaucagcagga

SEQ ID NO: 2919 - RNA, 19 nt, artificial
  Chemically synthesized
caucaacuuauuucuggaa

SEQ ID NO: 2920 - RNA, 19 nt, artificial
  Chemically synthesized
ggcucauagcucuguagau

SEQ ID NO: 2921 - RNA, 19 nt, artificial
  Chemically synthesized
gaucuauaacucugucauu

SEQ ID NO: 2922 - RNA, 19 nt, artificial
  Chemically synthesized
uccacuuuaccuggaucua

SEQ ID NO: 2923 - RNA, 19 nt, artificial
  Chemically synthesized
agccaggcccacaucauuu

SEQ ID NO: 2924 - RNA, 19 nt, artificial
  Chemically synthesized
uggccuggagccaggccca

SEQ ID NO: 2925 - RNA, 19 nt, artificial
  Chemically synthesized
gcaggaacagagcacagca

SEQ ID NO: 2926 - RNA, 19 nt, artificial
  Chemically synthesized
gagagggccaggcauccuc

SEQ ID NO: 2927 - RNA, 19 nt, artificial
  Chemically synthesized
ggauuucccaguaaguuua

SEQ ID NO: 2928 - RNA, 19 nt, artificial
  Chemically synthesized
ggaaugaagucccgcuuau

SEQ ID NO: 2929 - RNA, 19 nt, artificial
  Chemically synthesized
aggcccacaucauuuucau

SEQ ID NO: 2930 - RNA, 19 nt, artificial
  Chemically synthesized
cagcaggaacagagcacag

SEQ ID NO: 2931 - RNA, 19 nt, artificial
  Chemically synthesized
ccagcaaaaucuuuucuuu

SEQ ID NO: 2932 - RNA, 19 nt, artificial
  Chemically synthesized
gaauggcagcaucauuguu

SEQ ID NO: 2933 - RNA, 19 nt, artificial
  Chemically synthesized
caguaggcaucccgcucac

SEQ ID NO: 2934 - RNA, 19 nt, artificial
  Chemically synthesized
caaaaaucuccagcaguaa

SEQ ID NO: 2935 - RNA, 19 nt, artificial
  Chemically synthesized
gaaccagaaaaacuuuacu

SEQ ID NO: 2936 - RNA, 19 nt, artificial
  Chemically synthesized
cucaucaaaaagacggaaa

SEQ ID NO: 2937 - RNA, 19 nt, artificial
  Chemically synthesized
guucuuugaguugcggcaa

SEQ ID NO: 2938 - RNA, 19 nt, artificial
  Chemically synthesized
cuuugaguugcggcaaauu

SEQ ID NO: 2939 - RNA, 19 nt, artificial
  Chemically synthesized
cagugcuugcugcuccuga

SEQ ID NO: 2940 - RNA, 19 nt, artificial
  Chemically synthesized
ccaagacccacaccaucca

SEQ ID NO: 2941 - RNA, 19 nt, artificial
  Chemically synthesized
ccuguuguuggacagguca

SEQ ID NO: 2942 - RNA, 19 nt, artificial
  Chemically synthesized
gcuggauaaguucaaauau

SEQ ID NO: 2943 - RNA, 19 nt, artificial
  Chemically synthesized
gccugauuggaggauucuu

SEQ ID NO: 2944 - RNA, 19 nt, artificial
  Chemically synthesized
gcucuuuucaauggaguca

SEQ ID NO: 2945 - RNA, 19 nt, artificial
  Chemically synthesized
cggucacaagacagagaag

SEQ ID NO: 2946 - RNA, 19 nt, artificial
  Chemically synthesized
gguaagagggaggcaucug

SEQ ID NO: 2947 - RNA, 19 nt, artificial
  Chemically synthesized
cacgcacaugggauggaga

SEQ ID NO: 2948 - RNA, 19 nt, artificial
  Chemically synthesized
ccagcuccuggaccauaag

SEQ ID NO: 2949 - RNA, 19 nt, artificial
  Chemically synthesized
gagcaggaucagcaggaac

SEQ ID NO: 2950 - RNA, 19 nt, artificial
  Chemically synthesized
agggaagaaaaagaaucuu

SEQ ID NO: 2951 - RNA, 19 nt, artificial
  Chemically synthesized
cuugcugcuccugagugaa

SEQ ID NO: 2952 - RNA, 19 nt, artificial
  Chemically synthesized
gggaauggaguuuaaagau

SEQ ID NO: 2953 - RNA, 19 nt, artificial
  Chemically synthesized
ugggagcuuuccugggcuu

SEQ ID NO: 2954 - RNA, 19 nt, artificial
  Chemically synthesized
caggcccacaucauuuuca

SEQ ID NO: 2955 - RNA, 19 nt, artificial
  Chemically synthesized
ccacuccagguaggucuug

SEQ ID NO: 2956 - RNA, 19 nt, artificial
  Chemically synthesized
guaacauggguaagaggga

SEQ ID NO: 2957 - RNA, 19 nt, artificial
  Chemically synthesized
caaguuccucaaggaaggu

SEQ ID NO: 2958 - RNA, 19 nt, artificial
  Chemically synthesized
agagagggccaggcauccu

SEQ ID NO: 2959 - RNA, 19 nt, artificial
  Chemically synthesized
caucuaaaauuuccagugu

SEQ ID NO: 2960 - RNA, 19 nt, artificial
  Chemically synthesized
guuuccacuuuaccuggau

SEQ ID NO: 2961 - RNA, 19 nt, artificial
  Chemically synthesized
cacaugggauggagaguca

SEQ ID NO: 2962 - RNA, 19 nt, artificial
  Chemically synthesized
cuuccucuauuguguuaau

SEQ ID NO: 2963 - RNA, 19 nt, artificial
  Chemically synthesized
gaagguaaguccagcaaaa

SEQ ID NO: 2964 - RNA, 19 nt, artificial
  Chemically synthesized
ggaagguaaguccagcaaa

SEQ ID NO: 2965 - RNA, 19 nt, artificial
  Chemically synthesized
acuuuaccuggaucuauaa

SEQ ID NO: 2966 - RNA, 19 nt, artificial
  Chemically synthesized
caguaucucgcaguuccaa

SEQ ID NO: 2967 - RNA, 19 nt, artificial
  Chemically synthesized
gcuccuggaccauaagguu

SEQ ID NO: 2968 - RNA, 19 nt, artificial
  Chemically synthesized
agagggccaggcauccuca

SEQ ID NO: 2969 - RNA, 19 nt, artificial
  Chemically synthesized
gugugcuggauaaguucaa

SEQ ID NO: 2970 - RNA, 19 nt, artificial
  Chemically synthesized
gagggaggcaucugguaga

SEQ ID NO: 2971 - RNA, 19 nt, artificial
  Chemically synthesized
aggaaccagaaaaacuuua

SEQ ID NO: 2972 - RNA, 19 nt, artificial
  Chemically synthesized
gcacagcacaugccagaca

SEQ ID NO: 2973 - RNA, 19 nt, artificial
  Chemically synthesized
caccauccacaaaguaugu

SEQ ID NO: 2974 - RNA, 19 nt, artificial
  Chemically synthesized
cauggguaagagggaggca

SEQ ID NO: 2975 - RNA, 19 nt, artificial
  Chemically synthesized
gagaagccugauuggagga

SEQ ID NO: 2976 - RNA, 19 nt, artificial
  Chemically synthesized
guauucgugugcuggauaa

SEQ ID NO: 2977 - RNA, 19 nt, artificial
  Chemically synthesized
ccgcagcuugcagaagcgc

SEQ ID NO: 2978 - RNA, 19 nt, artificial
  Chemically synthesized
ggcugaauuuuucaaguau

SEQ ID NO: 2979 - RNA, 19 nt, artificial
  Chemically synthesized
cccaguaggcaucccgcuc

SEQ ID NO: 2980 - RNA, 19 nt, artificial
  Chemically synthesized
ugagcaggaucagcaggaa

SEQ ID NO: 2981 - RNA, 19 nt, artificial
  Chemically synthesized
gcauccucacaggcugaau

SEQ ID NO: 2982 - RNA, 19 nt, artificial
  Chemically synthesized
ggacaggucaaggcuuuuu

SEQ ID NO: 2983 - RNA, 19 nt, artificial
  Chemically synthesized
agggccaggcauccucaca

SEQ ID NO: 2984 - RNA, 19 nt, artificial
  Chemically synthesized
gggaaugcagccuguuaca

SEQ ID NO: 2985 - RNA, 19 nt, artificial
  Chemically synthesized
ccacuuuaccuggaucuau

SEQ ID NO: 2986 - RNA, 19 nt, artificial
  Chemically synthesized
gugcuugcugcuccugagu

SEQ ID NO: 2987 - RNA, 19 nt, artificial
  Chemically synthesized
gaggaauucacaggagcaa

SEQ ID NO: 2988 - RNA, 19 nt, artificial
  Chemically synthesized
ggaacagagcacagcacau

SEQ ID NO: 2989 - RNA, 19 nt, artificial
  Chemically synthesized
agguaauuugcuggccaau

SEQ ID NO: 2990 - RNA, 19 nt, artificial
  Chemically synthesized
gggagcuuuccugggcuuc

SEQ ID NO: 2991 - RNA, 19 nt, artificial
  Chemically synthesized
gggagaaguccaguucaua

SEQ ID NO: 2992 - RNA, 19 nt, artificial
  Chemically synthesized
gagagucacacagguaauu

SEQ ID NO: 2993 - RNA, 19 nt, artificial
  Chemically synthesized
cccgcuuaugaagacacaa

SEQ ID NO: 2994 - RNA, 19 nt, artificial
  Chemically synthesized
gcaggaucagcaggaacag

SEQ ID NO: 2995 - RNA, 19 nt, artificial
  Chemically synthesized
gggccacuccagguagguc

SEQ ID NO: 2996 - RNA, 19 nt, artificial
  Chemically synthesized
ccacaaaguauguggcauu

SEQ ID NO: 2997 - RNA, 19 nt, artificial
  Chemically synthesized
gccaggcauccucacaggc

SEQ ID NO: 2998 - RNA, 19 nt, artificial
  Chemically synthesized
cugacaaguuucaggcaua

SEQ ID NO: 2999 - RNA, 19 nt, artificial
  Chemically synthesized
cgcucacuguaagaaacaa

SEQ ID NO: 3000 - RNA, 19 nt, artificial
  Chemically synthesized
cuggagccaggcccacauc

SEQ ID NO: 3001 - RNA, 19 nt, artificial
  Chemically synthesized
gagaggcggacauccugaa

SEQ ID NO: 3002 - RNA, 19 nt, artificial
  Chemically synthesized
gggccaggcauccucacag

SEQ ID NO: 3003 - RNA, 19 nt, artificial
  Chemically synthesized
ccaguaggcaucccgcuca

SEQ ID NO: 3004 - RNA, 19 nt, artificial
  Chemically synthesized
gcucucagauuuacccaaa

SEQ ID NO: 3005 - RNA, 19 nt, artificial
  Chemically synthesized
ccugagggaauggaguuua

SEQ ID NO: 3006 - RNA, 19 nt, artificial
  Chemically synthesized
ggagagucacacagguaau

SEQ ID NO: 3007 - RNA, 19 nt, artificial
  Chemically synthesized
aggcauccucacaggcuga

SEQ ID NO: 3008 - RNA, 19 nt, artificial
  Chemically synthesized
gaaaaagaaucuuccucua

SEQ ID NO: 3009 - RNA, 19 nt, artificial
  Chemically synthesized
cgcacaugggauggagagu

SEQ ID NO: 3010 - RNA, 19 nt, artificial
  Chemically synthesized
gaguugcggcaaauucaaa

SEQ ID NO: 3011 - RNA, 19 nt, artificial
  Chemically synthesized
acugcccagggaagaaaaa

SEQ ID NO: 3012 - RNA, 19 nt, artificial
  Chemically synthesized
cccacaccauccacaaagu

SEQ ID NO: 3013 - RNA, 19 nt, artificial
  Chemically synthesized
cuguuguuggacaggucaa

SEQ ID NO: 3014 - RNA, 19 nt, artificial
  Chemically synthesized
ggagccaggcccacaucau

SEQ ID NO: 3015 - RNA, 19 nt, artificial
  Chemically synthesized
gggcuuccuuuuggccugg

SEQ ID NO: 3016 - RNA, 19 nt, artificial
  Chemically synthesized
gcuugcugcuccugaguga

SEQ ID NO: 3017 - RNA, 19 nt, artificial
  Chemically synthesized
gccacuccagguaggucuu

SEQ ID NO: 3018 - RNA, 19 nt, artificial
  Chemically synthesized
ccaugggccacuccaggua

SEQ ID NO: 3019 - RNA, 19 nt, artificial
  Chemically synthesized
ccacaccauccacaaagua

SEQ ID NO: 3020 - RNA, 19 nt, artificial
  Chemically synthesized
ccagugcuugcugcuccug

SEQ ID NO: 3021 - RNA, 19 nt, artificial
  Chemically synthesized
gccagugcuugcugcuccu

SEQ ID NO: 3022 - RNA, 19 nt, artificial
  Chemically synthesized
caggaucagcaggaacaga

SEQ ID NO: 3023 - RNA, 19 nt, artificial
  Chemically synthesized
gggaggcaucugguagagu

SEQ ID NO: 3024 - RNA, 19 nt, artificial
  Chemically synthesized
ccaggcccacaucauuuuc

SEQ ID NO: 3025 - RNA, 19 nt, artificial
  Chemically synthesized
ccuggagccaggcccacau

SEQ ID NO: 3026 - RNA, 19 nt, artificial
  Chemically synthesized
ccagaaaaacuuuacuguu

SEQ ID NO: 3027 - RNA, 19 nt, artificial
  Chemically synthesized
gcugcuccugagugaagga

SEQ ID NO: 3028 - RNA, 19 nt, artificial
  Chemically synthesized
cuccagcuccuggaccaua

SEQ ID NO: 3029 - RNA, 19 nt, artificial
  Chemically synthesized
gagggccaggcauccucac

SEQ ID NO: 3030 - RNA, 19 nt, artificial
  Chemically synthesized
cguuuccacuuuaccugga

SEQ ID NO: 3031 - RNA, 19 nt, artificial
  Chemically synthesized
ggguaagagggaggcaucu

SEQ ID NO: 3032 - RNA, 19 nt, artificial
  Chemically synthesized
gcaguaaaauaugcugcuu

SEQ ID NO: 3033 - RNA, 19 nt, artificial
  Chemically synthesized
ggccacgcacaugggaugg

SEQ ID NO: 3034 - RNA, 19 nt, artificial
  Chemically synthesized
gagccaggcccacaucauu

SEQ ID NO: 3035 - RNA, 19 nt, artificial
  Chemically synthesized
cucucagauuuacccaaaa

SEQ ID NO: 3036 - RNA, 19 nt, artificial
  Chemically synthesized
gcggcaaauucaaagaaaa

SEQ ID NO: 3037 - RNA, 19 nt, artificial
  Chemically synthesized
cccagggaagaaaaagaau

SEQ ID NO: 3038 - RNA, 19 nt, artificial
  Chemically synthesized
gauuucccaguaaguuuaa

SEQ ID NO: 3039 - RNA, 19 nt, artificial
  Chemically synthesized
cagguaauuugcuggccaa

SEQ ID NO: 3040 - RNA, 19 nt, artificial
  Chemically synthesized
cggcaaauucaaagaaaau

SEQ ID NO: 3041 - RNA, 19 nt, artificial
  Chemically synthesized
gcccagggaagaaaaagaa

SEQ ID NO: 3042 - RNA, 19 nt, artificial
  Chemically synthesized
ggccaggcauccucacagg

SEQ ID NO: 3043 - RNA, 19 nt, artificial
  Chemically synthesized
gccacgcacaugggaugga

SEQ ID NO: 3044 - RNA, 19 nt, artificial
  Chemically synthesized
cugagggaauggaguuuaa

SEQ ID NO: 3045 - RNA, 19 nt, artificial
  Chemically synthesized
ggcuuccuuuuggccugga

SEQ ID NO: 3046 - RNA, 19 nt, artificial
  Chemically synthesized
gccuggagccaggcccaca

SEQ ID NO: 3047 - RNA, 19 nt, artificial
  Chemically synthesized
gccaggcccacaucauuuu

SEQ ID NO: 3048 - RNA, 19 nt, artificial
  Chemically synthesized
gacccacaccauccacaaa

SEQ ID NO: 3049 - RNA, 19 nt, artificial
  Chemically synthesized
gcuggccacgcacauggga

SEQ ID NO: 3050 - RNA, 19 nt, artificial
  Chemically synthesized
ggcaucccgcucacuguaa

SEQ ID NO: 3051 - RNA, 19 nt, artificial
  Chemically synthesized
ggcccacaucauuuucaua

SEQ ID NO: 3052 - RNA, 19 nt, Artificial Sequence
  Chemically synthesized
ggcauccucacaggcugaa

SEQ ID NO: 3053 - RNA, 18 nt, artificial
  Chemically synthesized
ggaucucagugaaaauuu

SEQ ID NO: 3054 - RNA, 18 nt, artificial
  Chemically synthesized
gggucaucaucagccucu

SEQ ID NO: 3055 - RNA, 18 nt, artificial
  Chemically synthesized
ggacuucauuccuggcaa

SEQ ID NO: 3056 - RNA, 18 nt, artificial
  Chemically synthesized
ggcccucucuacaaacuu

SEQ ID NO: 3057 - RNA, 18 nt, artificial
  Chemically synthesized
ccaagacacuggaaauuu

SEQ ID NO: 3058 - RNA, 18 nt, artificial
  Chemically synthesized
ccuuguuuacuuucacaa

SEQ ID NO: 3059 - RNA, 18 nt, artificial
  Chemically synthesized
ggagcaacuugacucauu

SEQ ID NO: 3060 - RNA, 18 nt, artificial
  Chemically synthesized
gaaucacaguagaaaaca

SEQ ID NO: 3061 - RNA, 18 nt, artificial
  Chemically synthesized
gccucuccaaggaagaau

SEQ ID NO: 3062 - RNA, 18 nt, artificial
  Chemically synthesized
gucuaguugggaucuuua

SEQ ID NO: 3063 - RNA, 18 nt, artificial
  Chemically synthesized
ggcucagcgggaaggauu

SEQ ID NO: 3064 - RNA, 18 nt, artificial
  Chemically synthesized
ggagauuuuuguagaugu

SEQ ID NO: 3065 - RNA, 18 nt, artificial
  Chemically synthesized
ggauccaaaggagaccua

SEQ ID NO: 3066 - RNA, 18 nt, artificial
  Chemically synthesized
ggcugcauucccaagaca

SEQ ID NO: 3067 - RNA, 18 nt, artificial
  Chemically synthesized
gcaacaaggcaaaguauu

SEQ ID NO: 3068 - RNA, 18 nt, artificial
  Chemically synthesized
gcugcauauuccaagguu

SEQ ID NO: 3069 - RNA, 18 nt, artificial
  Chemically synthesized
gcauuuguuucuuacagu

SEQ ID NO: 3070 - RNA, 18 nt, artificial
  Chemically synthesized
guugaugacucuaccaga

SEQ ID NO: 3071 - RNA, 18 nt, artificial
  Chemically synthesized
ggaagaauccuccaauca

SEQ ID NO: 3072 - RNA, 18 nt, artificial
  Chemically synthesized
ggaaaaaaccggagagac

SEQ ID NO: 3073 - RNA, 18 nt, artificial
  Chemically synthesized
ggaucuuuaugucacuag

SEQ ID NO: 3074 - RNA, 18 nt, artificial
  Chemically synthesized
gaccagucuuugucuagu

SEQ ID NO: 3075 - RNA, 18 nt, artificial
  Chemically synthesized
ccgucuuuuugaugagaa

SEQ ID NO: 3076 - RNA, 18 nt, artificial
  Chemically synthesized
ccaugaucauaagucuau

SEQ ID NO: 3077 - RNA, 18 nt, artificial
  Chemically synthesized
ggaucuuuaaacuccauu

SEQ ID NO: 3078 - RNA, 18 nt, artificial
  Chemically synthesized
ggaguucucccaguguuu

SEQ ID NO: 3079 - RNA, 18 nt, artificial
  Chemically synthesized
caguguuugguguugcaa

SEQ ID NO: 3080 - RNA, 18 nt, artificial
  Chemically synthesized
cagucuuugucuaguugg

SEQ ID NO: 3081 - RNA, 18 nt, artificial
  Chemically synthesized
gguggagaaccuuauggu

SEQ ID NO: 3082 - RNA, 18 nt, artificial
  Chemically synthesized
gggaauugguugcaggau

SEQ ID NO: 3083 - RNA, 18 nt, artificial
  Chemically synthesized
cggaguucucccaguguu

SEQ ID NO: 3084 - RNA, 18 nt, artificial
  Chemically synthesized
agugaguggugcaaguau

SEQ ID NO: 3085 - RNA, 18 nt, artificial
  Chemically synthesized
gguaguuguggguugaag

SEQ ID NO: 3086 - RNA, 18 nt, artificial
  Chemically synthesized
gccugaaacuugucagug

SEQ ID NO: 3087 - RNA, 18 nt, artificial
  Chemically synthesized
gcaacaacaaucucaauu

SEQ ID NO: 3088 - RNA, 18 nt, artificial
  Chemically synthesized
ggaucauugacaauauca

SEQ ID NO: 3089 - RNA, 18 nt, artificial
  Chemically synthesized
gaauguaagucaucugau

SEQ ID NO: 3090 - RNA, 18 nt, artificial
  Chemically synthesized
ggagcuggagaacuucaa

SEQ ID NO: 3091 - RNA, 18 nt, artificial
  Chemically synthesized
ggcagucuugaacauuua

SEQ ID NO: 3092 - RNA, 18 nt, artificial
  Chemically synthesized
ggagagacuuugcucacu

SEQ ID NO: 3093 - RNA, 18 nt, artificial
  Chemically synthesized
aguggaucauugacaaua

SEQ ID NO: 3094 - RNA, 18 nt, artificial
  Chemically synthesized
ggauguaccgucauuuga

SEQ ID NO: 3095 - RNA, 18 nt, artificial
  Chemically synthesized
ccuuaauggaguugguaa

SEQ ID NO: 3096 - RNA, 18 nt, artificial
  Chemically synthesized
ggcaaaaucauuuggcau

SEQ ID NO: 3097 - RNA, 18 nt, artificial
  Chemically synthesized
caaugacugugucauucu

SEQ ID NO: 3098 - RNA, 18 nt, artificial
  Chemically synthesized
gucuuugucuaguuggga

SEQ ID NO: 3099 - RNA, 18 nt, artificial
  Chemically synthesized
gagcccauugagaaaaaa

SEQ ID NO: 3100 - RNA, 18 nt, artificial
  Chemically synthesized
gggaaauccuuacaaaac

SEQ ID NO: 3101 - RNA, 18 nt, artificial
  Chemically synthesized
ccaaagucuugauugauu

SEQ ID NO: 3102 - RNA, 18 nt, artificial
  Chemically synthesized
gaagaauccuccaaucag

SEQ ID NO: 3103 - RNA, 18 nt, artificial
  Chemically synthesized
ccuucacuaagauucaaa

SEQ ID NO: 3104 - RNA, 18 nt, artificial
  Chemically synthesized
cauauuuaagaccagucu

SEQ ID NO: 3105 - RNA, 18 nt, artificial
  Chemically synthesized
ggagaaccuuauggucca

SEQ ID NO: 3106 - RNA, 18 nt, artificial
  Chemically synthesized
gcgagauacugauuugga

SEQ ID NO: 3107 - RNA, 18 nt, artificial
  Chemically synthesized
gccucucggugucggaau

SEQ ID NO: 3108 - RNA, 18 nt, artificial
  Chemically synthesized
cacaguugguugacuuca

SEQ ID NO: 3109 - RNA, 18 nt, artificial
  Chemically synthesized
gcccauugcucuuucacu

SEQ ID NO: 3110 - RNA, 18 nt, artificial
  Chemically synthesized
cuuggaucucagugaaaa

SEQ ID NO: 3111 - RNA, 18 nt, artificial
  Chemically synthesized
ccacaaaaggcauucucu

SEQ ID NO: 3112 - RNA, 18 nt, artificial
  Chemically synthesized
guuccuuguuuacuuuca

SEQ ID NO: 3113 - RNA, 18 nt, artificial
  Chemically synthesized
cuuugugcuuucugaaaa

SEQ ID NO: 3114 - RNA, 18 nt, artificial
  Chemically synthesized
caaugaugcugccauucu

SEQ ID NO: 3115 - RNA, 18 nt, artificial
  Chemically synthesized
cauucucuguccuaccua

SEQ ID NO: 3116 - RNA, 18 nt, artificial
  Chemically synthesized
gaguggugcaaguaugaa

SEQ ID NO: 3117 - RNA, 18 nt, artificial
  Chemically synthesized
ggaacugcgagauacuga

SEQ ID NO: 3118 - RNA, 18 nt, artificial
  Chemically synthesized
cagucuugaacauuuaga

SEQ ID NO: 3119 - RNA, 18 nt, artificial
  Chemically synthesized
ggguaaaucugagagcug

SEQ ID NO: 3120 - RNA, 18 nt, artificial
  Chemically synthesized
ggacuuaccuuccuugag

SEQ ID NO: 3121 - RNA, 18 nt, artificial
  Chemically synthesized
cccaaaacuuguugcuau

SEQ ID NO: 3122 - RNA, 18 nt, artificial
  Chemically synthesized
ggacuugcuuacuaaaac

SEQ ID NO: 3123 - RNA, 18 nt, artificial
  Chemically synthesized
guuuggaacugcgagaua

SEQ ID NO: 3124 - RNA, 18 nt, artificial
  Chemically synthesized
cugaaaacuuugugaaga

SEQ ID NO: 3125 - RNA, 18 nt, artificial
  Chemically synthesized
cugcauauuccaagguuu

SEQ ID NO: 3126 - RNA, 18 nt, artificial
  Chemically synthesized
ugcggaagauaaugaaca

SEQ ID NO: 3127 - RNA, 18 nt, artificial
  Chemically synthesized
ggguggagaaccuuaugg

SEQ ID NO: 3128 - RNA, 18 nt, artificial
  Chemically synthesized
gcucggaguucucccagu

SEQ ID NO: 3129 - RNA, 18 nt, artificial
  Chemically synthesized
ggcucauugugcccauug

SEQ ID NO: 3130 - RNA, 18 nt, artificial
  Chemically synthesized
ggcugcauauuccaaggu

SEQ ID NO: 3131 - RNA, 18 nt, artificial
  Chemically synthesized
ccgcaaugguaucugcaa

SEQ ID NO: 3132 - RNA, 18 nt, artificial
  Chemically synthesized
cugcuaagagacuccucu

SEQ ID NO: 3133 - RNA, 18 nt, artificial
  Chemically synthesized
gaaucagauuucuggauu

SEQ ID NO: 3134 - RNA, 18 nt, artificial
  Chemically synthesized
agaaaaaagugcugugua

SEQ ID NO: 3135 - RNA, 18 nt, artificial
  Chemically synthesized
ccaauggaauuaacacaa

SEQ ID NO: 3136 - RNA, 18 nt, artificial
  Chemically synthesized
gaugguugaagaauacuu

SEQ ID NO: 3137 - RNA, 18 nt, artificial
  Chemically synthesized
ggaguugguaauuuuaga

SEQ ID NO: 3138 - RNA, 18 nt, artificial
  Chemically synthesized
gcaacagugaccuacaga

SEQ ID NO: 3139 - RNA, 18 nt, artificial
  Chemically synthesized
ccugagagugggaaauau

SEQ ID NO: 3140 - RNA, 18 nt, artificial
  Chemically synthesized
gugacugcucggaguucu

SEQ ID NO: 3141 - RNA, 18 nt, artificial
  Chemically synthesized
gugaauuccucuccuuca

SEQ ID NO: 3142 - RNA, 18 nt, artificial
  Chemically synthesized
gccaaagucuugauugau

SEQ ID NO: 3143 - RNA, 18 nt, artificial
  Chemically synthesized
gaacaaugaugcugccau

SEQ ID NO: 3144 - RNA, 18 nt, artificial
  Chemically synthesized
cacugaagacuuuggaag

SEQ ID NO: 3145 - RNA, 18 nt, artificial
  Chemically synthesized
cccauauuuaagaccagu

SEQ ID NO: 3146 - RNA, 18 nt, artificial
  Chemically synthesized
gcaacucaaagaacuuua

SEQ ID NO: 3147 - RNA, 18 nt, artificial
  Chemically synthesized
gguugaagcacuggacaa

SEQ ID NO: 3148 - RNA, 18 nt, artificial
  Chemically synthesized
cuaugagccaaaaaguuu

SEQ ID NO: 3149 - RNA, 18 nt, artificial
  Chemically synthesized
ugagauugaugcuucaga

SEQ ID NO: 3150 - RNA, 18 nt, artificial
  Chemically synthesized
gcaacuugacucauuuca

SEQ ID NO: 3151 - RNA, 18 nt, artificial
  Chemically synthesized
agagcuaugagccaaaaa

SEQ ID NO: 3152 - RNA, 18 nt, artificial
  Chemically synthesized
gagcaacaaggcaaagua

SEQ ID NO: 3153 - RNA, 18 nt, artificial
  Chemically synthesized
guggcaauaacuucauuu

SEQ ID NO: 3154 - RNA, 18 nt, artificial
  Chemically synthesized
ggugacugcucggaguuc

SEQ ID NO: 3155 - RNA, 18 nt, artificial
  Chemically synthesized
aguaugaacuggacuucu

SEQ ID NO: 3156 - RNA, 18 nt, artificial
  Chemically synthesized
ggacaaugccacauacuu

SEQ ID NO: 3157 - RNA, 18 nt, artificial
  Chemically synthesized
gccagaaaagaugaaaua

SEQ ID NO: 3158 - RNA, 18 nt, artificial
  Chemically synthesized
gugcuuucugaaaacuuu

SEQ ID NO: 3159 - RNA, 18 nt, artificial
  Chemically synthesized
ggccaacuguaaucugua

SEQ ID NO: 3160 - RNA, 18 nt, artificial
  Chemically synthesized
ggaacuugagauugaugc

SEQ ID NO: 3161 - RNA, 18 nt, artificial
  Chemically synthesized
guccuagguucccauauu

SEQ ID NO: 3162 - RNA, 18 nt, artificial
  Chemically synthesized
gcuggagauuuuuguaga

SEQ ID NO: 3163 - RNA, 18 nt, artificial
  Chemically synthesized
gccgcaacucaaagaacu

SEQ ID NO: 3164 - RNA, 18 nt, artificial
  Chemically synthesized
ugggcagucuugaacauu

SEQ ID NO: 3165 - RNA, 18 nt, artificial
  Chemically synthesized
gaauuagaguuugaugac

SEQ ID NO: 3166 - RNA, 18 nt, artificial
  Chemically synthesized
agcccauugagaaaaaag

SEQ ID NO: 3167 - RNA, 18 nt, artificial
  Chemically synthesized
ccagucuuugucuaguug

SEQ ID NO: 3168 - RNA, 18 nt, artificial
  Chemically synthesized
cccuucaaguugugucuu

SEQ ID NO: 3169 - RNA, 18 nt, artificial
  Chemically synthesized
ccauugagaaaaaagcca

SEQ ID NO: 3170 - RNA, 18 nt, artificial
  Chemically synthesized
ggaauugguugcaggauc

SEQ ID NO: 3171 - RNA, 18 nt, artificial
  Chemically synthesized
ugugcuuucugaaaacuu

SEQ ID NO: 3172 - RNA, 18 nt, artificial
  Chemically synthesized
gagagacuuugcucacuc

SEQ ID NO: 3173 - RNA, 18 nt, artificial
  Chemically synthesized
agcucuuagugaccaagu

SEQ ID NO: 3174 - RNA, 18 nt, artificial
  Chemically synthesized
ccaagaccuaccuggagu

SEQ ID NO: 3175 - RNA, 18 nt, artificial
  Chemically synthesized
uggcaucauuggaaaaaa

SEQ ID NO: 3176 - RNA, 18 nt, artificial
  Chemically synthesized
ccaaaggagaccuauagu

SEQ ID NO: 3177 - RNA, 18 nt, artificial
  Chemically synthesized
agaguuugaugacuguac

SEQ ID NO: 3178 - RNA, 18 nt, artificial
  Chemically synthesized
gccugugguauaugaaaa

SEQ ID NO: 3179 - RNA, 18 nt, artificial
  Chemically synthesized
cauccaauggaauuaaca

SEQ ID NO: 3180 - RNA, 18 nt, artificial
  Chemically synthesized
guugggaucuuuauguca

SEQ ID NO: 3181 - RNA, 18 nt, artificial
  Chemically synthesized
cugguuccuuguuuacuu

SEQ ID NO: 3182 - RNA, 18 nt, artificial
  Chemically synthesized
gcgauaaaguccuagguu

SEQ ID NO: 3183 - RNA, 18 nt, artificial
  Chemically synthesized
cuggguggagaaccuuau

SEQ ID NO: 3184 - RNA, 18 nt, artificial
  Chemically synthesized
gggaucuuuaugucacua

SEQ ID NO: 3185 - RNA, 18 nt, artificial
  Chemically synthesized
ccuggcaaguggaucauu

SEQ ID NO: 3186 - RNA, 18 nt, artificial
  Chemically synthesized
ggaauuaacacaauagag

SEQ ID NO: 3187 - RNA, 18 nt, artificial
  Chemically synthesized
gucaauucagaauguaag

SEQ ID NO: 3188 - RNA, 18 nt, artificial
  Chemically synthesized
cauugagaaaaaagccau

SEQ ID NO: 3189 - RNA, 18 nt, artificial
  Chemically synthesized
caguguaacaggcugcau

SEQ ID NO: 3190 - RNA, 18 nt, artificial
  Chemically synthesized
ggaacaucugcuaugaug

SEQ ID NO: 3191 - RNA, 18 nt, artificial
  Chemically synthesized
agcaggauccaaaggaga

SEQ ID NO: 3192 - RNA, 18 nt, artificial
  Chemically synthesized
ggagaccuauagugacuc

SEQ ID NO: 3193 - RNA, 18 nt, artificial
  Chemically synthesized
gugugaaccuccaggcuc

SEQ ID NO: 3194 - RNA, 18 nt, artificial
  Chemically synthesized
gcagaacccauggauaua

SEQ ID NO: 3195 - RNA, 18 nt, artificial
  Chemically synthesized
auccaaaggagaccuaua

SEQ ID NO: 3196 - RNA, 18 nt, artificial
  Chemically synthesized
gagcuaugagccaaaaag

SEQ ID NO: 3197 - RNA, 18 nt, artificial
  Chemically synthesized
gcugcauucccaagacac

SEQ ID NO: 3198 - RNA, 18 nt, artificial
  Chemically synthesized
gcacaaaugaacuuaaga

SEQ ID NO: 3199 - RNA, 18 nt, artificial
  Chemically synthesized
cccuuucuucuuuaacau

SEQ ID NO: 3200 - RNA, 18 nt, artificial
  Chemically synthesized
gaauauagucccuuggua

SEQ ID NO: 3201 - RNA, 18 nt, artificial
  Chemically synthesized
agaccagucuuugucuag

SEQ ID NO: 3202 - RNA, 18 nt, artificial
  Chemically synthesized
aguuguggguugaagcac

SEQ ID NO: 3203 - RNA, 18 nt, artificial
  Chemically synthesized
ggcaauaacuucauuugc

SEQ ID NO: 3204 - RNA, 18 nt, artificial
  Chemically synthesized
caaggaagaauccuccaa

SEQ ID NO: 3205 - RNA, 18 nt, artificial
  Chemically synthesized
ccacaaaacugucuuugu

SEQ ID NO: 3206 - RNA, 18 nt, artificial
  Chemically synthesized
gguggcaauaacuucauu

SEQ ID NO: 3207 - RNA, 18 nt, artificial
  Chemically synthesized
guaggaaugcaauaacua

SEQ ID NO: 3208 - RNA, 18 nt, artificial
  Chemically synthesized
ggcuucucugucuuguga

SEQ ID NO: 3209 - RNA, 18 nt, artificial
  Chemically synthesized
cucuuucacugcuuucaa

SEQ ID NO: 3210 - RNA, 18 nt, artificial
  Chemically synthesized
gagcaacuugacucauuu

SEQ ID NO: 3211 - RNA, 18 nt, artificial
  Chemically synthesized
caagcaggauccaaagga

SEQ ID NO: 3212 - RNA, 18 nt, artificial
  Chemically synthesized
ggauuguuagaauuagag

SEQ ID NO: 3213 - RNA, 18 nt, artificial
  Chemically synthesized
aguccuagguucccauau

SEQ ID NO: 3214 - RNA, 18 nt, artificial
  Chemically synthesized
gcaauaacuucauuugcu

SEQ ID NO: 3215 - RNA, 18 nt, artificial
  Chemically synthesized
gguccugugccaccguuu

SEQ ID NO: 3216 - RNA, 18 nt, artificial
  Chemically synthesized
cguggauaucaaaauuca

SEQ ID NO: 3217 - RNA, 18 nt, artificial
  Chemically synthesized
ccggagagacuuugcuca

SEQ ID NO: 3218 - RNA, 18 nt, artificial
  Chemically synthesized
aguguaacaggcugcauu

SEQ ID NO: 3219 - RNA, 18 nt, artificial
  Chemically synthesized
ggaagcugguggcaauaa

SEQ ID NO: 3220 - RNA, 18 nt, artificial
  Chemically synthesized
gagugaguggugcaagua

SEQ ID NO: 3221 - RNA, 18 nt, artificial
  Chemically synthesized
cucauuucacacacugaa

SEQ ID NO: 3222 - RNA, 18 nt, artificial
  Chemically synthesized
cuccaaucaggcuucucu

SEQ ID NO: 3223 - RNA, 18 nt, artificial
  Chemically synthesized
gggaaauauggacaccuu

SEQ ID NO: 3224 - RNA, 18 nt, artificial
  Chemically synthesized
cccaggagcucuuaguga

SEQ ID NO: 3225 - RNA, 18 nt, artificial
  Chemically synthesized
ggagcucuuagugaccaa

SEQ ID NO: 3226 - RNA, 18 nt, artificial
  Chemically synthesized
caggcugcauucccaaga

SEQ ID NO: 3227 - RNA, 18 nt, artificial
  Chemically synthesized
gacaccuucacuaagauu

SEQ ID NO: 3228 - RNA, 18 nt, artificial
  Chemically synthesized
ggaggcugcauauuccaa

SEQ ID NO: 3229 - RNA, 18 nt, artificial
  Chemically synthesized
gacuguacccuuaaugga

SEQ ID NO: 3230 - RNA, 18 nt, artificial
  Chemically synthesized
agauaaugaacaccaaga

SEQ ID NO: 3231 - RNA, 18 nt, artificial
  Chemically synthesized
gacuaacauugauaucag

SEQ ID NO: 3232 - RNA, 18 nt, artificial
  Chemically synthesized
cucacaaaauugcaaauc

SEQ ID NO: 3233 - RNA, 18 nt, artificial
  Chemically synthesized
agauuuugcuggacuuac

SEQ ID NO: 3234 - RNA, 18 nt, artificial
  Chemically synthesized
ggacaccuucacuaagau

SEQ ID NO: 3235 - RNA, 18 nt, artificial
  Chemically synthesized
cugcuaugaugcauuugu

SEQ ID NO: 3236 - RNA, 18 nt, artificial
  Chemically synthesized
gcauauuccaagguuuua

SEQ ID NO: 3237 - RNA, 18 nt, artificial
  Chemically synthesized
ggaaauccuuacaaaacc

SEQ ID NO: 3238 - RNA, 18 nt, artificial
  Chemically synthesized
gcaaguaugaacuggacu

SEQ ID NO: 3239 - RNA, 18 nt, artificial
  Chemically synthesized
gucuugaacauuuagacu

SEQ ID NO: 3240 - RNA, 18 nt, artificial
  Chemically synthesized
gcuuaguucauuaggaaa

SEQ ID NO: 3241 - RNA, 18 nt, artificial
  Chemically synthesized
cuaagagacuccucugug

SEQ ID NO: 3242 - RNA, 18 nt, artificial
  Chemically synthesized
gccacaaaaggcauucuc

SEQ ID NO: 3243 - RNA, 18 nt, artificial
  Chemically synthesized
ggaagauucuuuuucuuc

SEQ ID NO: 3244 - RNA, 18 nt, artificial
  Chemically synthesized
gguccaggagcuggagaa

SEQ ID NO: 3245 - RNA, 18 nt, artificial
  Chemically synthesized
aucugauaaugacagagu

SEQ ID NO: 3246 - RNA, 18 nt, artificial
  Chemically synthesized
gagcuggagaacuucaau

SEQ ID NO: 3247 - RNA, 18 nt, artificial
  Chemically synthesized
gcuccugugaauuccucu

SEQ ID NO: 3248 - RNA, 18 nt, artificial
  Chemically synthesized
gguucaggauguccgccu

SEQ ID NO: 3249 - RNA, 18 nt, artificial
  Chemically synthesized
cggagagacuuugcucac

SEQ ID NO: 3250 - RNA, 18 nt, artificial
  Chemically synthesized
cacagaagcuguaaaaag

SEQ ID NO: 3251 - RNA, 18 nt, artificial
  Chemically synthesized
ccugaaacuugucagugg

SEQ ID NO: 3252 - RNA, 18 nt, artificial
  Chemically synthesized
gcuucucugucuugugac

SEQ ID NO: 3253 - RNA, 18 nt, artificial
  Chemically synthesized
agugcuguguauuuccua

SEQ ID NO: 3254 - RNA, 18 nt, artificial
  Chemically synthesized
ccugugaauuccucuccu

SEQ ID NO: 3255 - RNA, 18 nt, artificial
  Chemically synthesized
caguaggaaugcaauaac

SEQ ID NO: 3256 - RNA, 18 nt, artificial
  Chemically synthesized
gagccacaaaacugucuu

SEQ ID NO: 3257 - RNA, 18 nt, artificial
  Chemically synthesized
ccuacuggguggagaacc

SEQ ID NO: 3258 - RNA, 18 nt, artificial
  Chemically synthesized
ccuugaggaacuugagau

SEQ ID NO: 3259 - RNA, 18 nt, artificial
  Chemically synthesized
gauugauuggccagcaaa

SEQ ID NO: 3260 - RNA, 18 nt, artificial
  Chemically synthesized
cuacauuagcaacaguga

SEQ ID NO: 3261 - RNA, 18 nt, artificial
  Chemically synthesized
guggauguaccgucauuu

SEQ ID NO: 3262 - RNA, 18 nt, artificial
  Chemically synthesized
gcuaugaugcauuuguuu

SEQ ID NO: 3263 - RNA, 18 nt, artificial
  Chemically synthesized
gugcaaguaugaacugga

SEQ ID NO: 3264 - RNA, 18 nt, artificial
  Chemically synthesized
guuugaugacuguacccu

SEQ ID NO: 3265 - RNA, 18 nt, artificial
  Chemically synthesized
gaauacacaguguaacag

SEQ ID NO: 3266 - RNA, 18 nt, artificial
  Chemically synthesized
gaaaaaaccggagagacu

SEQ ID NO: 3267 - RNA, 18 nt, artificial
  Chemically synthesized
aggacuugcuuacuaaaa

SEQ ID NO: 3268 - RNA, 18 nt, artificial
  Chemically synthesized
auauuuuacugcuggaga

SEQ ID NO: 3269 - RNA, 18 nt, artificial
  Chemically synthesized
guggaucauugacaauau

SEQ ID NO: 3270 - RNA, 18 nt, artificial
  Chemically synthesized
ccagaaauaaguugauga

SEQ ID NO: 3271 - RNA, 18 nt, artificial
  Chemically synthesized
gaucuuuaugucacuagu

SEQ ID NO: 3272 - RNA, 18 nt, artificial
  Chemically synthesized
aaggaagaauccuccaau

SEQ ID NO: 3273 - RNA, 18 nt, artificial
  Chemically synthesized
gcaggauccaaaggagac

SEQ ID NO: 3274 - RNA, 18 nt, artificial
  Chemically synthesized
gaagauaaugaacaccaa

SEQ ID NO: 3275 - RNA, 18 nt, artificial
  Chemically synthesized
cugagcacuuuauauuca

SEQ ID NO: 3276 - RNA, 18 nt, artificial
  Chemically synthesized
agcaacaaggcaaaguau

SEQ ID NO: 3277 - RNA, 18 nt, artificial
  Chemically synthesized
acugcgagauacugauuu

SEQ ID NO: 3278 - RNA, 18 nt, artificial
  Chemically synthesized
agcuggagaacuucaauc

SEQ ID NO: 3279 - RNA, 18 nt, artificial
  Chemically synthesized
ccauauuuaagaccaguc

SEQ ID NO: 3280 - RNA, 18 nt, artificial
  Chemically synthesized
caaguugugucuucauaa

SEQ ID NO: 3281 - RNA, 18 nt, artificial
  Chemically synthesized
cugugaauuccucuccuu

SEQ ID NO: 3282 - RNA, 18 nt, artificial
  Chemically synthesized
aguguuugguguugcaag

SEQ ID NO: 3283 - RNA, 18 nt, artificial
  Chemically synthesized
gaucugagcacuuuauau

SEQ ID NO: 3284 - RNA, 18 nt, artificial
  Chemically synthesized
gugaccaagugaagguac

SEQ ID NO: 3285 - RNA, 18 nt, artificial
  Chemically synthesized
cccucagggcucacagaa

SEQ ID NO: 3286 - RNA, 18 nt, artificial
  Chemically synthesized
gaguucucccaguguuug

SEQ ID NO: 3287 - RNA, 18 nt, artificial
  Chemically synthesized
cuggagaacuucaauccc

SEQ ID NO: 3288 - RNA, 18 nt, artificial
  Chemically synthesized
cuaugagauaaccaugau

SEQ ID NO: 3289 - RNA, 18 nt, artificial
  Chemically synthesized
gcuuucaacugguaguug

SEQ ID NO: 3290 - RNA, 18 nt, artificial
  Chemically synthesized
guuugguguugcaagcag

SEQ ID NO: 3291 - RNA, 18 nt, artificial
  Chemically synthesized
gccacauacuuuguggau

SEQ ID NO: 3292 - RNA, 18 nt, artificial
  Chemically synthesized
gagccaaaaaguuugaag

SEQ ID NO: 3293 - RNA, 18 nt, artificial
  Chemically synthesized
ccacauacuuuguggaug

SEQ ID NO: 3294 - RNA, 18 nt, artificial
  Chemically synthesized
cagugaaaauuugauggu

SEQ ID NO: 3295 - RNA, 18 nt, artificial
  Chemically synthesized
ccagcaaauuaccugugu

SEQ ID NO: 3296 - RNA, 18 nt, artificial
  Chemically synthesized
cuugaaaaauucagccug

SEQ ID NO: 3297 - RNA, 18 nt, artificial
  Chemically synthesized
cacaaaauugcaaauccu

SEQ ID NO: 3298 - RNA, 18 nt, artificial
  Chemically synthesized
cugucuugugaccgcaau

SEQ ID NO: 3299 - RNA, 18 nt, artificial
  Chemically synthesized
ugaugacucuaccagaug

SEQ ID NO: 3300 - RNA, 18 nt, artificial
  Chemically synthesized
gcaacuggcuuaguucau

SEQ ID NO: 3301 - RNA, 18 nt, artificial
  Chemically synthesized
ggccacaaaaggcauucu

SEQ ID NO: 3302 - RNA, 18 nt, artificial
  Chemically synthesized
gcaggauccucguggaua

SEQ ID NO: 3303 - RNA, 18 nt, artificial
  Chemically synthesized
gauguaccgucauuugag

SEQ ID NO: 3304 - RNA, 18 nt, artificial
  Chemically synthesized
ucggaguucucccagugu

SEQ ID NO: 3305 - RNA, 18 nt, artificial
  Chemically synthesized
ugggaaauccuuacaaaa

SEQ ID NO: 3306 - RNA, 18 nt, artificial
  Chemically synthesized
cauggaugcagaacccau

SEQ ID NO: 3307 - RNA, 18 nt, artificial
  Chemically synthesized
ugaagacuuuggaagcug

SEQ ID NO: 3308 - RNA, 18 nt, artificial
  Chemically synthesized
ggaugcagaacccaugga

SEQ ID NO: 3309 - RNA, 18 nt, artificial
  Chemically synthesized
gauucucaaugacugugu

SEQ ID NO: 3310 - RNA, 18 nt, artificial
  Chemically synthesized
agccaaaaaguuugaagu

SEQ ID NO: 3311 - RNA, 18 nt, artificial
  Chemically synthesized
gagauugaugcuucagau

SEQ ID NO: 3312 - RNA, 18 nt, artificial
  Chemically synthesized
gguaauuuuagagcaucu

SEQ ID NO: 3313 - RNA, 18 nt, artificial
  Chemically synthesized
ggaaggauuuuggguaaa

SEQ ID NO: 3314 - RNA, 18 nt, artificial
  Chemically synthesized
gcaucugauaaugacaga

SEQ ID NO: 3315 - RNA, 18 nt, artificial
  Chemically synthesized
gauguuagcaacaacaau

SEQ ID NO: 3316 - RNA, 18 nt, artificial
  Chemically synthesized
gaacuggacuucucccau

SEQ ID NO: 3317 - RNA, 18 nt, artificial
  Chemically synthesized
gcgagaaagcgcagccag

SEQ ID NO: 3318 - RNA, 18 nt, artificial
  Chemically synthesized
cauuucacacacugaaga

SEQ ID NO: 3319 - RNA, 18 nt, artificial
  Chemically synthesized
ccugggcagucuugaaca

SEQ ID NO: 3320 - RNA, 18 nt, artificial
  Chemically synthesized
gcugcggaagauaaugaa

SEQ ID NO: 3321 - RNA, 18 nt, artificial
  Chemically synthesized
agcuaugagccaaaaagu

SEQ ID NO: 3322 - RNA, 18 nt, artificial
  Chemically synthesized
caaucaggcuucucuguc

SEQ ID NO: 3323 - RNA, 18 nt, artificial
  Chemically synthesized
acuggguggagaaccuua

SEQ ID NO: 3324 - RNA, 18 nt, artificial
  Chemically synthesized
ugaaaaucaccgaugaaa

SEQ ID NO: 3325 - RNA, 18 nt, artificial
  Chemically synthesized
cugauaaugacagaguua

SEQ ID NO: 3326 - RNA, 18 nt, artificial
  Chemically synthesized
gagauacugauuuggaca

SEQ ID NO: 3327 - RNA, 18 nt, artificial
  Chemically synthesized
cuucauuccuggcaagug

SEQ ID NO: 3328 - RNA, 18 nt, artificial
  Chemically synthesized
cccaagacacuggaaauu

SEQ ID NO: 3329 - RNA, 18 nt, artificial
  Chemically synthesized
gguguugcaagcaggauc

SEQ ID NO: 3330 - RNA, 18 nt, artificial
  Chemically synthesized
gcccauugagaaaaaagc

SEQ ID NO: 3331 - RNA, 18 nt, artificial
  Chemically synthesized
gcugacauccaauggaau

SEQ ID NO: 3332 - RNA, 18 nt, artificial
  Chemically synthesized
cacacacugaagacuuug

SEQ ID NO: 3333 - RNA, 18 nt, artificial
  Chemically synthesized
agaccuaccuggaguggc

SEQ ID NO: 3334 - RNA, 18 nt, artificial
  Chemically synthesized
gccacaaaacugucuuug

SEQ ID NO: 3335 - RNA, 18 nt, artificial
  Chemically synthesized
ggcugcucggcguucucu

SEQ ID NO: 3336 - RNA, 18 nt, artificial
  Chemically synthesized
ccaagugaagguaccugu

SEQ ID NO: 3337 - RNA, 18 nt, artificial
  Chemically synthesized
caucugcuaugaugcauu

SEQ ID NO: 3338 - RNA, 18 nt, artificial
  Chemically synthesized
aacuugagauugaugcuu

SEQ ID NO: 3339 - RNA, 18 nt, artificial
  Chemically synthesized
ggaaacagcacaaaugaa

SEQ ID NO: 3340 - RNA, 18 nt, artificial
  Chemically synthesized
caaaauugcaaauccuga

SEQ ID NO: 3341 - RNA, 18 nt, artificial
  Chemically synthesized
gugucauucuuucuuccu

SEQ ID NO: 3342 - RNA, 18 nt, artificial
  Chemically synthesized
gggaaacaucucuuuuuu

SEQ ID NO: 3343 - RNA, 18 nt, artificial
  Chemically synthesized
gucaucugauccuucaua

SEQ ID NO: 3344 - RNA, 18 nt, artificial
  Chemically synthesized
gacauccaauggaauuaa

SEQ ID NO: 3345 - RNA, 18 nt, artificial
  Chemically synthesized
cagguaaaguggaaacgu

SEQ ID NO: 3346 - RNA, 18 nt, artificial
  Chemically synthesized
cugugcagcugaucucaa

SEQ ID NO: 3347 - RNA, 18 nt, artificial
  Chemically synthesized
ggugcuguuuuauaaaca

SEQ ID NO: 3348 - RNA, 18 nt, artificial
  Chemically synthesized
ugaucugagcacuuuaua

SEQ ID NO: 3349 - RNA, 18 nt, artificial
  Chemically synthesized
gcuccaggccaaaaggaa

SEQ ID NO: 3350 - RNA, 18 nt, artificial
  Chemically synthesized
cauaugaagcagcauauu

SEQ ID NO: 3351 - RNA, 18 nt, artificial
  Chemically synthesized
gucaguggccagaaaaga

SEQ ID NO: 3352 - RNA, 18 nt, artificial
  Chemically synthesized
gagagugggaaauaugga

SEQ ID NO: 3353 - RNA, 18 nt, artificial
  Chemically synthesized
cauucucauucuucugga

SEQ ID NO: 3354 - RNA, 18 nt, artificial
  Chemically synthesized
gacugugucauucuuucu

SEQ ID NO: 3355 - RNA, 18 nt, artificial
  Chemically synthesized
ggacagcacuggugucug

SEQ ID NO: 3356 - RNA, 18 nt, artificial
  Chemically synthesized
ggaaugcaauaacuacgu

SEQ ID NO: 3357 - RNA, 18 nt, artificial
  Chemically synthesized
gaggaacuugagauugau

SEQ ID NO: 3358 - RNA, 18 nt, artificial
  Chemically synthesized
guggguugaagcacugga

SEQ ID NO: 3359 - RNA, 18 nt, artificial
  Chemically synthesized
ccagaugccucccucuua

SEQ ID NO: 3360 - RNA, 18 nt, artificial
  Chemically synthesized
cuuucaacugguaguugu

SEQ ID NO: 3361 - RNA, 18 nt, artificial
  Chemically synthesized
gagcaucugauaaugaca

SEQ ID NO: 3362 - RNA, 18 nt, artificial
  Chemically synthesized
gaggcugcauauuccaag

SEQ ID NO: 3363 - RNA, 18 nt, artificial
  Chemically synthesized
cauugacuccauugaaaa

SEQ ID NO: 3364 - RNA, 18 nt, artificial
  Chemically synthesized
uugucuaguugggaucuu

SEQ ID NO: 3365 - RNA, 18 nt, artificial
  Chemically synthesized
caaguuccguggaauguu

SEQ ID NO: 3366 - RNA, 18 nt, artificial
  Chemically synthesized
uggaaaaaaccggagaga

SEQ ID NO: 3367 - RNA, 18 nt, artificial
  Chemically synthesized
uccugagagugggaaaua

SEQ ID NO: 3368 - RNA, 18 nt, artificial
  Chemically synthesized
guggagaaccuuaugguc

SEQ ID NO: 3369 - RNA, 18 nt, artificial
  Chemically synthesized
ggcauucucuguccuacc

SEQ ID NO: 3370 - RNA, 18 nt, artificial
  Chemically synthesized
cacaaaaggcauucucug

SEQ ID NO: 3371 - RNA, 18 nt, artificial
  Chemically synthesized
uggacaccuucacuaaga

SEQ ID NO: 3372 - RNA, 18 nt, artificial
  Chemically synthesized
cuagguucccauauuuaa

SEQ ID NO: 3373 - RNA, 18 nt, artificial
  Chemically synthesized
cgaugaaaguuuguuuca

SEQ ID NO: 3374 - RNA, 18 nt, artificial
  Chemically synthesized
gauccuucauaugaagca

SEQ ID NO: 3375 - RNA, 18 nt, artificial
  Chemically synthesized
agugaccaagugaaggua

SEQ ID NO: 3376 - RNA, 18 nt, artificial
  Chemically synthesized
ugaggaacuugagauuga

SEQ ID NO: 3377 - RNA, 18 nt, artificial
  Chemically synthesized
caagcugcggaagauaau

SEQ ID NO: 3378 - RNA, 18 nt, artificial
  Chemically synthesized
cauuugaggacuugcuua

SEQ ID NO: 3379 - RNA, 18 nt, artificial
  Chemically synthesized
aacuguaaucuguagcaa

SEQ ID NO: 3380 - RNA, 18 nt, artificial
  Chemically synthesized
cagauuucuggauuguua

SEQ ID NO: 3381 - RNA, 18 nt, artificial
  Chemically synthesized
cucaaugacugugucauu

SEQ ID NO: 3382 - RNA, 18 nt, artificial
  Chemically synthesized
aaaggagaccuauaguga

SEQ ID NO: 3383 - RNA, 18 nt, artificial
  Chemically synthesized
ggcaucauuggaaaaaac

SEQ ID NO: 3384 - RNA, 18 nt, artificial
  Chemically synthesized
cauacuuuguggauggug

SEQ ID NO: 3385 - RNA, 18 nt, artificial
  Chemically synthesized
cuguacccuuaauggagu

SEQ ID NO: 3386 - RNA, 18 nt, artificial
  Chemically synthesized
cagugagcgggaugccua

SEQ ID NO: 3387 - RNA, 18 nt, artificial
  Chemically synthesized
ccuugguauccaagggaa

SEQ ID NO: 3388 - RNA, 18 nt, artificial
  Chemically synthesized
aagaccagucuuugucua

SEQ ID NO: 3389 - RNA, 18 nt, artificial
  Chemically synthesized
cuaugaugcauuuguuuc

SEQ ID NO: 3390 - RNA, 18 nt, artificial
  Chemically synthesized
caggcuucucugucuugu

SEQ ID NO: 3391 - RNA, 18 nt, artificial
  Chemically synthesized
agcugguggcaauaacuu

SEQ ID NO: 3392 - RNA, 18 nt, artificial
  Chemically synthesized
ccuggcccucucuacaaa

SEQ ID NO: 3393 - RNA, 18 nt, artificial
  Chemically synthesized
uggagauuuuuguagaug

SEQ ID NO: 3394 - RNA, 18 nt, artificial
  Chemically synthesized
acacaauagaggaagauu

SEQ ID NO: 3395 - RNA, 18 nt, artificial
  Chemically synthesized
uagaauacuuggaucuca

SEQ ID NO: 3396 - RNA, 18 nt, artificial
  Chemically synthesized
gcuaagagacuccucugu

SEQ ID NO: 3397 - RNA, 18 nt, artificial
  Chemically synthesized
gaauguuuggaacugcga

SEQ ID NO: 3398 - RNA, 18 nt, artificial
  Chemically synthesized
agguucccauauuuaaga

SEQ ID NO: 3399 - RNA, 18 nt, artificial
  Chemically synthesized
ccuagaaaaaagugcugu

SEQ ID NO: 3400 - RNA, 18 nt, artificial
  Chemically synthesized
gaacauuuagacuuaucc

SEQ ID NO: 3401 - RNA, 18 nt, artificial
  Chemically synthesized
ccauuuccgucuuuuuga

SEQ ID NO: 3402 - RNA, 18 nt, artificial
  Chemically synthesized
gagaaaaaagccauuccc

SEQ ID NO: 3403 - RNA, 18 nt, artificial
  Chemically synthesized
auuuaagaccagucuuug

SEQ ID NO: 3404 - RNA, 18 nt, artificial
  Chemically synthesized
gguucccauauuuaagac

SEQ ID NO: 3405 - RNA, 18 nt, artificial
  Chemically synthesized
ggauauagagggccaacu

SEQ ID NO: 3406 - RNA, 18 nt, artificial
  Chemically synthesized
cugugucauucuuucuuc

SEQ ID NO: 3407 - RNA, 18 nt, artificial
  Chemically synthesized
gguaaaucugagagcugc

SEQ ID NO: 3408 - RNA, 18 nt, artificial
  Chemically synthesized
accaugaucauaagucua

SEQ ID NO: 3409 - RNA, 18 nt, artificial
  Chemically synthesized
ggugucggaaugucacag

SEQ ID NO: 3410 - RNA, 18 nt, artificial
  Chemically synthesized
gccuacuggguggagaac

SEQ ID NO: 3411 - RNA, 18 nt, artificial
  Chemically synthesized
gcuggacuuaccuuccuu

SEQ ID NO: 3412 - RNA, 18 nt, artificial
  Chemically synthesized
gcuaugagccaaaaaguu

SEQ ID NO: 3413 - RNA, 18 nt, artificial
  Chemically synthesized
agaucuacagagcuauga

SEQ ID NO: 3414 - RNA, 18 nt, artificial
  Chemically synthesized
agagacuuugcucacucu

SEQ ID NO: 3415 - RNA, 18 nt, artificial
  Chemically synthesized
uacccauguuacuaguau

SEQ ID NO: 3416 - RNA, 18 nt, artificial
  Chemically synthesized
agauguuagcaacaacaa

SEQ ID NO: 3417 - RNA, 18 nt, artificial
  Chemically synthesized
gaaauaaguugaugacuc

SEQ ID NO: 3418 - RNA, 18 nt, artificial
  Chemically synthesized
gaucuacagagcuaugag

SEQ ID NO: 3419 - RNA, 18 nt, artificial
  Chemically synthesized
augacugugucauucuuu

SEQ ID NO: 3420 - RNA, 18 nt, artificial
  Chemically synthesized
guugguaauuuuagagca

SEQ ID NO: 3421 - RNA, 18 nt, artificial
  Chemically synthesized
cauuagaauacuuggauc

SEQ ID NO: 3422 - RNA, 18 nt, artificial
  Chemically synthesized
aaaaggaagcccaggaaa

SEQ ID NO: 3423 - RNA, 18 nt, artificial
  Chemically synthesized
gugucuucauaagcggga

SEQ ID NO: 3424 - RNA, 18 nt, artificial
  Chemically synthesized
aggcucuggugcugacau

SEQ ID NO: 3425 - RNA, 18 nt, artificial
  Chemically synthesized
cugagagugggaaauaug

SEQ ID NO: 3426 - RNA, 18 nt, artificial
  Chemically synthesized
ccauuuuucagaacuauc

SEQ ID NO: 3427 - RNA, 18 nt, artificial
  Chemically synthesized
gacaaugccacauacuuu

SEQ ID NO: 3428 - RNA, 18 nt, artificial
  Chemically synthesized
gaaaaauucagccuguga

SEQ ID NO: 3429 - RNA, 18 nt, artificial
  Chemically synthesized
gcagcauauuuuacugcu

SEQ ID NO: 3430 - RNA, 18 nt, artificial
  Chemically synthesized
ggccaaagucuugauuga

SEQ ID NO: 3431 - RNA, 18 nt, artificial
  Chemically synthesized
caauccggaggcugcaua

SEQ ID NO: 3432 - RNA, 18 nt, artificial
  Chemically synthesized
gaguuugaugacuguacc

SEQ ID NO: 3433 - RNA, 18 nt, artificial
  Chemically synthesized
caaaaggcauucucuguc

SEQ ID NO: 3434 - RNA, 18 nt, artificial
  Chemically synthesized
cggcguucucucagguga

SEQ ID NO: 3435 - RNA, 18 nt, artificial
  Chemically synthesized
gaaaagagccacaaaacu

SEQ ID NO: 3436 - RNA, 18 nt, artificial
  Chemically synthesized
aggcauucucuguccuac

SEQ ID NO: 3437 - RNA, 18 nt, artificial
  Chemically synthesized
gcaaauuaccugugugac

SEQ ID NO: 3438 - RNA, 18 nt, artificial
  Chemically synthesized
ccgcaacucaaagaacuu

SEQ ID NO: 3439 - RNA, 18 nt, artificial
  Chemically synthesized
gaagcugguggcaauaac

SEQ ID NO: 3440 - RNA, 18 nt, artificial
  Chemically synthesized
cguggaauguuuggaacu

SEQ ID NO: 3441 - RNA, 18 nt, artificial
  Chemically synthesized
ggucaucaucagccucuc

SEQ ID NO: 3442 - RNA, 18 nt, artificial
  Chemically synthesized
agcgagaaagcgcagcca

SEQ ID NO: 3443 - RNA, 18 nt, artificial
  Chemically synthesized
aucugaauauagucccuu

SEQ ID NO: 3444 - RNA, 18 nt, artificial
  Chemically synthesized
ugaugguugaagaauacu

SEQ ID NO: 3445 - RNA, 18 nt, artificial
  Chemically synthesized
acuguaaucuguagcaac

SEQ ID NO: 3446 - RNA, 18 nt, artificial
  Chemically synthesized
ccucguggauaucaaaau

SEQ ID NO: 3447 - RNA, 18 nt, artificial
  Chemically synthesized
cuaccuagcugucacuuc

SEQ ID NO: 3448 - RNA, 18 nt, artificial
  Chemically synthesized
ucugguuccuuguuuacu

SEQ ID NO: 3449 - RNA, 18 nt, artificial
  Chemically synthesized
ccaggagcuggagaacuu

SEQ ID NO: 3450 - RNA, 18 nt, artificial
  Chemically synthesized
cguggauguaccgucauu

SEQ ID NO: 3451 - RNA, 18 nt, artificial
  Chemically synthesized
aguggaaacguuaacaau

SEQ ID NO: 3452 - RNA, 18 nt, artificial
  Chemically synthesized
aaaaaaccggagagacuu

SEQ ID NO: 3453 - RNA, 18 nt, artificial
  Chemically synthesized
guuguggguugaagcacu

SEQ ID NO: 3454 - RNA, 18 nt, artificial
  Chemically synthesized
ggauggugugggucuugg

SEQ ID NO: 3455 - RNA, 18 nt, artificial
  Chemically synthesized
caauaucauugacuccau

SEQ ID NO: 3456 - RNA, 18 nt, artificial
  Chemically synthesized
cgauaaaguccuagguuc

SEQ ID NO: 3457 - RNA, 18 nt, artificial
  Chemically synthesized
gaccuauagugacuccca

SEQ ID NO: 3458 - RNA, 18 nt, artificial
  Chemically synthesized
gcuggagaacuucaaucc

SEQ ID NO: 3459 - RNA, 18 nt, artificial
  Chemically synthesized
caacaaggcaaaguauuu

SEQ ID NO: 3460 - RNA, 18 nt, artificial
  Chemically synthesized
agcacuggugucuggcau

SEQ ID NO: 3461 - RNA, 18 nt, artificial
  Chemically synthesized
gaagcagcauauuuuacu

SEQ ID NO: 3462 - RNA, 18 nt, artificial
  Chemically synthesized
cuuugaauuugccgcaac

SEQ ID NO: 3463 - RNA, 18 nt, artificial
  Chemically synthesized
gaauuccucuccuucacu

SEQ ID NO: 3464 - RNA, 18 nt, artificial
  Chemically synthesized
ccucucuacaaacuuuaa

SEQ ID NO: 3465 - RNA, 18 nt, artificial
  Chemically synthesized
guagcaacuggcuuaguu

SEQ ID NO: 3466 - RNA, 18 nt, artificial
  Chemically synthesized
cucccauuuccgucuuuu

SEQ ID NO: 3467 - RNA, 18 nt, artificial
  Chemically synthesized
gaugagaacaaugaugcu

SEQ ID NO: 3468 - RNA, 18 nt, artificial
  Chemically synthesized
ugcucggaguucucccag

SEQ ID NO: 3469 - RNA, 18 nt, artificial
  Chemically synthesized
ucuuugucuaguugggau

SEQ ID NO: 3470 - RNA, 18 nt, artificial
  Chemically synthesized
gauaaugaacaccaagac

SEQ ID NO: 3471 - RNA, 18 nt, artificial
  Chemically synthesized
aggaacaucugcuaugau

SEQ ID NO: 3472 - RNA, 18 nt, artificial
  Chemically synthesized
ugcucacucugaaaaacu

SEQ ID NO: 3473 - RNA, 18 nt, artificial
  Chemically synthesized
ccuugaccuguccaacaa

SEQ ID NO: 3474 - RNA, 18 nt, artificial
  Chemically synthesized
auucuaugccugaaacuu

SEQ ID NO: 3475 - RNA, 18 nt, artificial
  Chemically synthesized
aaggcauucucuguccua

SEQ ID NO: 3476 - RNA, 18 nt, artificial
  Chemically synthesized
uucccaagacacuggaaa

SEQ ID NO: 3477 - RNA, 18 nt, artificial
  Chemically synthesized
caaguaugaacuggacuu

SEQ ID NO: 3478 - RNA, 18 nt, artificial
  Chemically synthesized
uggaucucagugaaaauu

SEQ ID NO: 3479 - RNA, 18 nt, artificial
  Chemically synthesized
cuuacugggaaauccuua

SEQ ID NO: 3480 - RNA, 18 nt, artificial
  Chemically synthesized
acguuuucuaaggagcaa

SEQ ID NO: 3481 - RNA, 18 nt, artificial
  Chemically synthesized
acugugucauucuuucuu

SEQ ID NO: 3482 - RNA, 18 nt, artificial
  Chemically synthesized
cauucuucuggagcccau

SEQ ID NO: 3483 - RNA, 18 nt, artificial
  Chemically synthesized
ugagaacaaugaugcugc

SEQ ID NO: 3484 - RNA, 18 nt, artificial
  Chemically synthesized
acuacguuuucuaaggag

SEQ ID NO: 3485 - RNA, 18 nt, artificial
  Chemically synthesized
ccuucauaugaagcagca

SEQ ID NO: 3486 - RNA, 18 nt, artificial
  Chemically synthesized
gaaacuugucaguggcca

SEQ ID NO: 3487 - RNA, 18 nt, artificial
  Chemically synthesized
uguagauguuacaaguuc

SEQ ID NO: 3488 - RNA, 18 nt, artificial
  Chemically synthesized
cuucauggaugcagaacc

SEQ ID NO: 3489 - RNA, 18 nt, artificial
  Chemically synthesized
ccuacagaggugugugaa

SEQ ID NO: 3490 - RNA, 18 nt, artificial
  Chemically synthesized
cugaagacuuuggaagcu

SEQ ID NO: 3491 - RNA, 18 nt, artificial
  Chemically synthesized
augagauaaccaugauca

SEQ ID NO: 3492 - RNA, 18 nt, artificial
  Chemically synthesized
gauuuuggguaaaucuga

SEQ ID NO: 3493 - RNA, 18 nt, artificial
  Chemically synthesized
cuugugaccgcaauggua

SEQ ID NO: 3494 - RNA, 18 nt, artificial
  Chemically synthesized
acuucauggaugcagaac

SEQ ID NO: 3495 - RNA, 18 nt, artificial
  Chemically synthesized
gaacugcgagauacugau

SEQ ID NO: 3496 - RNA, 18 nt, artificial
  Chemically synthesized
aguggugcaaguaugaac

SEQ ID NO: 3497 - RNA, 18 nt, artificial
  Chemically synthesized
ugcauuuguuucuuacag

SEQ ID NO: 3498 - RNA, 18 nt, artificial
  Chemically synthesized
acaauaucauugacucca

SEQ ID NO: 3499 - RNA, 18 nt, artificial
  Chemically synthesized
ugcuucagaucuacagag

SEQ ID NO: 3500 - RNA, 18 nt, artificial
  Chemically synthesized
cacgaauacacaguguaa

SEQ ID NO: 3501 - RNA, 18 nt, artificial
  Chemically synthesized
aggcaaaaucauuuggca

SEQ ID NO: 3502 - RNA, 18 nt, artificial
  Chemically synthesized
cgaauacacaguguaaca

SEQ ID NO: 3503 - RNA, 18 nt, artificial
  Chemically synthesized
gcuauuccuagaaaaaag

SEQ ID NO: 3504 - RNA, 18 nt, artificial
  Chemically synthesized
gugugacucuccauccca

SEQ ID NO: 3505 - RNA, 18 nt, artificial
  Chemically synthesized
cucccaguguuugguguu

SEQ ID NO: 3506 - RNA, 18 nt, artificial
  Chemically synthesized
ggcucuggugcugacauc

SEQ ID NO: 3507 - RNA, 18 nt, artificial
  Chemically synthesized
guaagucaucugauccuu

SEQ ID NO: 3508 - RNA, 18 nt, artificial
  Chemically synthesized
gcaagcugcggaagauaa

SEQ ID NO: 3509 - RNA, 18 nt, artificial
  Chemically synthesized
gugcuguguauuuccuau

SEQ ID NO: 3510 - RNA, 18 nt, artificial
  Chemically synthesized
gaugaaaguuuguuucag

SEQ ID NO: 3511 - RNA, 18 nt, artificial
  Chemically synthesized
cauucuaugccugaaacu

SEQ ID NO: 3512 - RNA, 18 nt, artificial
  Chemically synthesized
uucacacacugaagacuu

SEQ ID NO: 3513 - RNA, 18 nt, artificial
  Chemically synthesized
ggguccugugccaccguu

SEQ ID NO: 3514 - RNA, 18 nt, artificial
  Chemically synthesized
caacagugaccuacagag

SEQ ID NO: 3515 - RNA, 18 nt, artificial
  Chemically synthesized
auucuuucuuccugcuaa

SEQ ID NO: 3516 - RNA, 18 nt, artificial
  Chemically synthesized
cauuugcuccugugaauu

SEQ ID NO: 3517 - RNA, 18 nt, artificial
  Chemically synthesized
uagaguuugaugacugua

SEQ ID NO: 3518 - RNA, 18 nt, artificial
  Chemically synthesized
ugguaguuguggguugaa

SEQ ID NO: 3519 - RNA, 18 nt, artificial
  Chemically synthesized
accagucuuugucuaguu

SEQ ID NO: 3520 - RNA, 18 nt, artificial
  Chemically synthesized
aggagcaacuugacucau

SEQ ID NO: 3521 - RNA, 18 nt, artificial
  Chemically synthesized
gcucacucugaaaaacuu

SEQ ID NO: 3522 - RNA, 18 nt, artificial
  Chemically synthesized
gcacacgaauacacagug

SEQ ID NO: 3523 - RNA, 18 nt, artificial
  Chemically synthesized
auuggaaaaaaccggaga

SEQ ID NO: 3524 - RNA, 18 nt, artificial
  Chemically synthesized
cuuaauggaguugguaau

SEQ ID NO: 3525 - RNA, 18 nt, artificial
  Chemically synthesized
cuuccuugaggaacuuga

SEQ ID NO: 3526 - RNA, 18 nt, artificial
  Chemically synthesized
ucuaguugggaucuuuau

SEQ ID NO: 3527 - RNA, 18 nt, artificial
  Chemically synthesized
gaaggauuuuggguaaau

SEQ ID NO: 3528 - RNA, 18 nt, artificial
  Chemically synthesized
agcgggacuucauuccug

SEQ ID NO: 3529 - RNA, 18 nt, artificial
  Chemically synthesized
cucggugucggaauguca

SEQ ID NO: 3530 - RNA, 18 nt, artificial
  Chemically synthesized
caauagaggaagauucuu

SEQ ID NO: 3531 - RNA, 18 nt, artificial
  Chemically synthesized
caagggaauugguugcag

SEQ ID NO: 3532 - RNA, 18 nt, artificial
  Chemically synthesized
ggcaugugcugugcucug

SEQ ID NO: 3533 - RNA, 18 nt, artificial
  Chemically synthesized
uguggauggugugggucu

SEQ ID NO: 3534 - RNA, 18 nt, artificial
  Chemically synthesized
ccucagggcucacagaag

SEQ ID NO: 3535 - RNA, 18 nt, artificial
  Chemically synthesized
gacucuaccagaugccuc

SEQ ID NO: 3536 - RNA, 18 nt, artificial
  Chemically synthesized
cucggaguucucccagug

SEQ ID NO: 3537 - RNA, 18 nt, artificial
  Chemically synthesized
ucagaauguaagucaucu

SEQ ID NO: 3538 - RNA, 18 nt, artificial
  Chemically synthesized
ugaugagaacaaugaugc

SEQ ID NO: 3539 - RNA, 18 nt, artificial
  Chemically synthesized
ugcaaauccugagagugg

SEQ ID NO: 3540 - RNA, 18 nt, artificial
  Chemically synthesized
aguugugucuucauaagc

SEQ ID NO: 3541 - RNA, 18 nt, artificial
  Chemically synthesized
cguuuucuaaggagcaac

SEQ ID NO: 3542 - RNA, 18 nt, artificial
  Chemically synthesized
gcaucauuggaaaaaacc

SEQ ID NO: 3543 - RNA, 18 nt, artificial
  Chemically synthesized
ccagcacacgaauacaca

SEQ ID NO: 3544 - RNA, 18 nt, artificial
  Chemically synthesized
ucuaugagauaaccauga

SEQ ID NO: 3545 - RNA, 18 nt, artificial
  Chemically synthesized
ugaagucaauucagaaug

SEQ ID NO: 3546 - RNA, 18 nt, artificial
  Chemically synthesized
gaggaagauucuuuuucu

SEQ ID NO: 3547 - RNA, 18 nt, artificial
  Chemically synthesized
agaauguaagucaucuga

SEQ ID NO: 3548 - RNA, 18 nt, artificial
  Chemically synthesized
cauugugcccauugcucu

SEQ ID NO: 3549 - RNA, 18 nt, artificial
  Chemically synthesized
aguuuucauucuaugccu

SEQ ID NO: 3550 - RNA, 18 nt, artificial
  Chemically synthesized
gauacugauuuggacacu

SEQ ID NO: 3551 - RNA, 18 nt, artificial
  Chemically synthesized
ccugugguauaugaaaau

SEQ ID NO: 3552 - RNA, 18 nt, artificial
  Chemically synthesized
cucuguuccugcugaucc

SEQ ID NO: 3553 - RNA, 18 nt, artificial
  Chemically synthesized
agaacaaugaugcugcca

SEQ ID NO: 3554 - RNA, 18 nt, artificial
  Chemically synthesized
cuccauucccucagggcu

SEQ ID NO: 3555 - RNA, 18 nt, artificial
  Chemically synthesized
caaauuaccugugugacu

SEQ ID NO: 3556 - RNA, 18 nt, artificial
  Chemically synthesized
ugaugacuguacccuuaa

SEQ ID NO: 3557 - RNA, 18 nt, artificial
  Chemically synthesized
gaaaacuuugugaagagu

SEQ ID NO: 3558 - RNA, 18 nt, artificial
  Chemically synthesized
cuugguauccaagggaau

SEQ ID NO: 3559 - RNA, 18 nt, artificial
  Chemically synthesized
ugccauucucauucuucu

SEQ ID NO: 3560 - RNA, 18 nt, artificial
  Chemically synthesized
cuucaaguugugucuuca

SEQ ID NO: 3561 - RNA, 18 nt, artificial
  Chemically synthesized
ugguguugcaagcaggau

SEQ ID NO: 3562 - RNA, 18 nt, artificial
  Chemically synthesized
aggccaaaaggaagccca

SEQ ID NO: 3563 - RNA, 18 nt, artificial
  Chemically synthesized
ccguggaauguuuggaac

SEQ ID NO: 3564 - RNA, 18 nt, artificial
  Chemically synthesized
augcagaacccauggaua

SEQ ID NO: 3565 - RNA, 18 nt, artificial
  Chemically synthesized
cuuugucuaguugggauc

SEQ ID NO: 3566 - RNA, 18 nt, artificial
  Chemically synthesized
gaaaaaagugcuguguau

SEQ ID NO: 3567 - RNA, 18 nt, artificial
  Chemically synthesized
gagugggaaauauggaca

SEQ ID NO: 3568 - RNA, 18 nt, artificial
  Chemically synthesized
ugguugacuucauggaug

SEQ ID NO: 3569 - RNA, 18 nt, artificial
  Chemically synthesized
cauugcucuuucacugcu

SEQ ID NO: 3570 - RNA, 18 nt, artificial
  Chemically synthesized
ggcguucucucaggugac

SEQ ID NO: 3571 - RNA, 18 nt, artificial
  Chemically synthesized
guggaaacguuaacaauc

SEQ ID NO: 3572 - RNA, 18 nt, artificial
  Chemically synthesized
cauaagcgggacuucauu

SEQ ID NO: 3573 - RNA, 18 nt, artificial
  Chemically synthesized
aggcucagcgggaaggau

SEQ ID NO: 3574 - RNA, 18 nt, artificial
  Chemically synthesized
auugcaaauccugagagu

SEQ ID NO: 3575 - RNA, 18 nt, artificial
  Chemically synthesized
aggauuuuggguaaaucu

SEQ ID NO: 3576 - RNA, 18 nt, artificial
  Chemically synthesized
acacugaagacuuuggaa

SEQ ID NO: 3577 - RNA, 18 nt, artificial
  Chemically synthesized
agccucuccaaggaagaa

SEQ ID NO: 3578 - RNA, 18 nt, artificial
  Chemically synthesized
agcugaucucaagagcaa

SEQ ID NO: 3579 - RNA, 18 nt, artificial
  Chemically synthesized
cuaaggagcaacuugacu

SEQ ID NO: 3580 - RNA, 18 nt, artificial
  Chemically synthesized
gaguuaaaagaaucacag

SEQ ID NO: 3581 - RNA, 18 nt, artificial
  Chemically synthesized
cuggugcugacauccaau

SEQ ID NO: 3582 - RNA, 18 nt, artificial
  Chemically synthesized
caucaucagccucuccaa

SEQ ID NO: 3583 - RNA, 18 nt, artificial
  Chemically synthesized
ugggaaauauggacaccu

SEQ ID NO: 3584 - RNA, 18 nt, artificial
  Chemically synthesized
guugguugacuucaugga

SEQ ID NO: 3585 - RNA, 18 nt, artificial
  Chemically synthesized
gcggcugcucggcguucu

SEQ ID NO: 3586 - RNA, 18 nt, artificial
  Chemically synthesized
acaggaucaccuacauua

SEQ ID NO: 3587 - RNA, 18 nt, artificial
  Chemically synthesized
gcuucagaucuacagagc

SEQ ID NO: 3588 - RNA, 18 nt, artificial
  Chemically synthesized
gauccacaguugguugac

SEQ ID NO: 3589 - RNA, 18 nt, artificial
  Chemically synthesized
cccucuuacccauguuac

SEQ ID NO: 3590 - RNA, 18 nt, artificial
  Chemically synthesized
cugccauucucauucuuc

SEQ ID NO: 3591 - RNA, 18 nt, artificial
  Chemically synthesized
aaaacuacguggauguac

SEQ ID NO: 3592 - RNA, 18 nt, artificial
  Chemically synthesized
auugaugcuucagaucua

SEQ ID NO: 3593 - RNA, 18 nt, artificial
  Chemically synthesized
agcugucacuucucugug

SEQ ID NO: 3594 - RNA, 18 nt, artificial
  Chemically synthesized
uuuggaagcugguggcaa

SEQ ID NO: 3595 - RNA, 18 nt, artificial
  Chemically synthesized
augguaucugcaagggca

SEQ ID NO: 3596 - RNA, 18 nt, artificial
  Chemically synthesized
aaggagaccuauagugac

SEQ ID NO: 3597 - RNA, 18 nt, artificial
  Chemically synthesized
ccuaccuagcugucacuu

SEQ ID NO: 3598 - RNA, 18 nt, artificial
  Chemically synthesized
ccuccaaucaggcuucuc

SEQ ID NO: 3599 - RNA, 18 nt, artificial
  Chemically synthesized
guuacaaguuccguggaa

SEQ ID NO: 3600 - RNA, 18 nt, artificial
  Chemically synthesized
cuuccugcuaagagacuc

SEQ ID NO: 3601 - RNA, 18 nt, artificial
  Chemically synthesized
acguggauguaccgucau

SEQ ID NO: 3602 - RNA, 18 nt, artificial
  Chemically synthesized
augagaacaaugaugcug

SEQ ID NO: 3603 - RNA, 18 nt, artificial
  Chemically synthesized
gaagagugaguggugcaa

SEQ ID NO: 3604 - RNA, 18 nt, artificial
  Chemically synthesized
aaaucaguaggaaugcaa

SEQ ID NO: 3605 - RNA, 18 nt, artificial
  Chemically synthesized
ccuagcugucacuucucu

SEQ ID NO: 3606 - RNA, 18 nt, artificial
  Chemically synthesized
guaugaacuggacuucuc

SEQ ID NO: 3607 - RNA, 18 nt, artificial
  Chemically synthesized
ggaggcagcgagaaagcg

SEQ ID NO: 3608 - RNA, 18 nt, artificial
  Chemically synthesized
ggcggcugcucggcguuc

SEQ ID NO: 3609 - RNA, 18 nt, artificial
  Chemically synthesized
cgccucucggugucggaa

SEQ ID NO: 3610 - RNA, 18 nt, artificial
  Chemically synthesized
aaacugucuuugugcuuu

SEQ ID NO: 3611 - RNA, 18 nt, artificial
  Chemically synthesized
cuuugugaagagugagug

SEQ ID NO: 3612 - RNA, 18 nt, artificial
  Chemically synthesized
acagugaccuacagaggu

SEQ ID NO: 3613 - RNA, 18 nt, artificial
  Chemically synthesized
guuucuuacagugagcgg

SEQ ID NO: 3614 - RNA, 18 nt, artificial
  Chemically synthesized
ugguaauuuuagagcauc

SEQ ID NO: 3615 - RNA, 18 nt, artificial
  Chemically synthesized
ggaaacaucucuuuuuuc

SEQ ID NO: 3616 - RNA, 18 nt, artificial
  Chemically synthesized
cuccaaggaagaauccuc

SEQ ID NO: 3617 - RNA, 18 nt, artificial
  Chemically synthesized
caccaagaccuaccugga

SEQ ID NO: 3618 - RNA, 18 nt, artificial
  Chemically synthesized
acaguugguugacuucau

SEQ ID NO: 3619 - RNA, 18 nt, artificial
  Chemically synthesized
ccugcuaagagacuccuc

SEQ ID NO: 3620 - RNA, 18 nt, artificial
  Chemically synthesized
ugagcacuuuauauucac

SEQ ID NO: 3621 - RNA, 18 nt, artificial
  Chemically synthesized
caggauccaaaggagacc

SEQ ID NO: 3622 - RNA, 18 nt, artificial
  Chemically synthesized
cuugacucauuucacaca

SEQ ID NO: 3623 - RNA, 18 nt, artificial
  Chemically synthesized
gagacuccucuguggcca

SEQ ID NO: 3624 - RNA, 18 nt, artificial
  Chemically synthesized
uuuguuucuuacagugag

SEQ ID NO: 3625 - RNA, 18 nt, artificial
  Chemically synthesized
gggcucauugugcccauu

SEQ ID NO: 3626 - RNA, 18 nt, artificial
  Chemically synthesized
agacuuuggaagcuggug

SEQ ID NO: 3627 - RNA, 18 nt, artificial
  Chemically synthesized
uguccuaccuagcuguca

SEQ ID NO: 3628 - RNA, 18 nt, artificial
  Chemically synthesized
gaauacuuggaucucagu

SEQ ID NO: 3629 - RNA, 18 nt, artificial
  Chemically synthesized
gacucuccaucccaugug

SEQ ID NO: 3630 - RNA, 18 nt, artificial
  Chemically synthesized
cucucggugucggaaugu

SEQ ID NO: 3631 - RNA, 18 nt, artificial
  Chemically synthesized
gaucaccuacauuagcaa

SEQ ID NO: 3632 - RNA, 18 nt, artificial
  Chemically synthesized
uggccagaaaagaugaaa

SEQ ID NO: 3633 - RNA, 18 nt, artificial
  Chemically synthesized
augcuucagaucuacaga

SEQ ID NO: 3634 - RNA, 18 nt, artificial
  Chemically synthesized
acuucucugugcagcuga

SEQ ID NO: 3635 - RNA, 18 nt, artificial
  Chemically synthesized
cugcauucccaagacacu

SEQ ID NO: 3636 - RNA, 18 nt, artificial
  Chemically synthesized
ugcugacauccaauggaa

SEQ ID NO: 3637 - RNA, 18 nt, artificial
  Chemically synthesized
auccacuggugaaacaaa

SEQ ID NO: 3638 - RNA, 18 nt, artificial
  Chemically synthesized
ugaugcuucagaucuaca

SEQ ID NO: 3639 - RNA, 18 nt, artificial
  Chemically synthesized
acuugaaaaauucagccu

SEQ ID NO: 3640 - RNA, 18 nt, artificial
  Chemically synthesized
guggaauguuuggaacug

SEQ ID NO: 3641 - RNA, 18 nt, artificial
  Chemically synthesized
gugucuggcaugugcugu

SEQ ID NO: 3642 - RNA, 18 nt, artificial
  Chemically synthesized
auuagaguuugaugacug

SEQ ID NO: 3643 - RNA, 18 nt, artificial
  Chemically synthesized
gcggaagauaaugaacac

SEQ ID NO: 3644 - RNA, 18 nt, artificial
  Chemically synthesized
gaaauauggacaccuuca

SEQ ID NO: 3645 - RNA, 18 nt, artificial
  Chemically synthesized
accuuaugguccaggagc

SEQ ID NO: 3646 - RNA, 18 nt, artificial
  Chemically synthesized
gauucuuuuucuucccug

SEQ ID NO: 3647 - RNA, 18 nt, artificial
  Chemically synthesized
ggccaaaaggaagcccag

SEQ ID NO: 3648 - RNA, 18 nt, artificial
  Chemically synthesized
agauguuacaaguuccgu

SEQ ID NO: 3649 - RNA, 18 nt, artificial
  Chemically synthesized
caaguggaucauugacaa

SEQ ID NO: 3650 - RNA, 18 nt, artificial
  Chemically synthesized
cacaauagaggaagauuc

SEQ ID NO: 3651 - RNA, 18 nt, artificial
  Chemically synthesized
agaacccauggauauaga

SEQ ID NO: 3652 - RNA, 18 nt, artificial
  Chemically synthesized
caucugauaaugacagag

SEQ ID NO: 3653 - RNA, 18 nt, artificial
  Chemically synthesized
ucacagaagcuguaaaaa

SEQ ID NO: 3654 - RNA, 18 nt, artificial
  Chemically synthesized
gaagcuguaaaaagccuu

SEQ ID NO: 3655 - RNA, 18 nt, artificial
  Chemically synthesized
accaagaccuaccuggag

SEQ ID NO: 3656 - RNA, 18 nt, artificial
  Chemically synthesized
ugucauucuuucuuccug

SEQ ID NO: 3657 - RNA, 18 nt, artificial
  Chemically synthesized
cacuggaaauuuuagaug

SEQ ID NO: 3658 - RNA, 18 nt, artificial
  Chemically synthesized
uccaggagcuggagaacu

SEQ ID NO: 3659 - RNA, 18 nt, artificial
  Chemically synthesized
uucacuuacagaaagagu

SEQ ID NO: 3660 - RNA, 18 nt, artificial
  Chemically synthesized
ucacaaaauugcaaaucc

SEQ ID NO: 3661 - RNA, 18 nt, artificial
  Chemically synthesized
gaugacuguacccuuaau

SEQ ID NO: 3662 - RNA, 18 nt, artificial
  Chemically synthesized
ucugcaagcugcggaaga

SEQ ID NO: 3663 - RNA, 18 nt, artificial
  Chemically synthesized
cuguaaucuguagcaacu

SEQ ID NO: 3664 - RNA, 18 nt, artificial
  Chemically synthesized
ucucaaugacugugucau

SEQ ID NO: 3665 - RNA, 18 nt, artificial
  Chemically synthesized
cucuuacccauguuacua

SEQ ID NO: 3666 - RNA, 18 nt, artificial
  Chemically synthesized
ugagaaaaaagccauucc

SEQ ID NO: 3667 - RNA, 18 nt, artificial
  Chemically synthesized
cuaguugggaucuuuaug

SEQ ID NO: 3668 - RNA, 18 nt, artificial
  Chemically synthesized
auaaguugaugacucuac

SEQ ID NO: 3669 - RNA, 18 nt, artificial
  Chemically synthesized
agaauacuuggaucucag

SEQ ID NO: 3670 - RNA, 18 nt, artificial
  Chemically synthesized
uccacaguugguugacuu

SEQ ID NO: 3671 - RNA, 18 nt, artificial
  Chemically synthesized
uaaccaugaucauaaguc

SEQ ID NO: 3672 - RNA, 18 nt, artificial
  Chemically synthesized
acuguacccuuaauggag

SEQ ID NO: 3673 - RNA, 18 nt, artificial
  Chemically synthesized
guugugucuucauaagcg

SEQ ID NO: 3674 - RNA, 18 nt, artificial
  Chemically synthesized
gugcucuguuccugcuga

SEQ ID NO: 3675 - RNA, 18 nt, artificial
  Chemically synthesized
gccagcagguucaggaug

SEQ ID NO: 3676 - RNA, 18 nt, artificial
  Chemically synthesized
caccuacauuagcaacag

SEQ ID NO: 3677 - RNA, 18 nt, artificial
  Chemically synthesized
ucugagagcugcgauaaa

SEQ ID NO: 3678 - RNA, 18 nt, artificial
  Chemically synthesized
gcaagggcagcucaggau

SEQ ID NO: 3679 - RNA, 18 nt, artificial
  Chemically synthesized
cugucacuucucugugca

SEQ ID NO: 3680 - RNA, 18 nt, artificial
  Chemically synthesized
caaaaucauuuggcauca

SEQ ID NO: 3681 - RNA, 18 nt, artificial
  Chemically synthesized
cccauugcucuuucacug

SEQ ID NO: 3682 - RNA, 18 nt, artificial
  Chemically synthesized
ucugauccuucauaugaa

SEQ ID NO: 3683 - RNA, 18 nt, artificial
  Chemically synthesized
agagccacaaaacugucu

SEQ ID NO: 3684 - RNA, 18 nt, artificial
  Chemically synthesized
guggugcaaguaugaacu

SEQ ID NO: 3685 - RNA, 18 nt, artificial
  Chemically synthesized
gacacuggaaauuuuaga

SEQ ID NO: 3686 - RNA, 18 nt, artificial
  Chemically synthesized
ugccgcaacucaaagaac

SEQ ID NO: 3687 - RNA, 18 nt, artificial
  Chemically synthesized
cuggcccucucuacaaac

SEQ ID NO: 3688 - RNA, 18 nt, artificial
  Chemically synthesized
gaacccauggauauagag

SEQ ID NO: 3689 - RNA, 18 nt, artificial
  Chemically synthesized
ggauguccgccucucggu

SEQ ID NO: 3690 - RNA, 18 nt, artificial
  Chemically synthesized
cucagugaaaauuugaug

SEQ ID NO: 3691 - RNA, 18 nt, artificial
  Chemically synthesized
cacaaaacugucuuugug

SEQ ID NO: 3692 - RNA, 18 nt, artificial
  Chemically synthesized
guugaagcacuggacaau

SEQ ID NO: 3693 - RNA, 18 nt, artificial
  Chemically synthesized
gaaugcaauaacuacguu

SEQ ID NO: 3694 - RNA, 18 nt, artificial
  Chemically synthesized
gaaccuuaugguccagga

SEQ ID NO: 3695 - RNA, 18 nt, artificial
  Chemically synthesized
caaagucuugauugauug

SEQ ID NO: 3696 - RNA, 18 nt, artificial
  Chemically synthesized
gcaugugcugugcucugu

SEQ ID NO: 3697 - RNA, 18 nt, artificial
  Chemically synthesized
ugguuccuuguuuacuuu

SEQ ID NO: 3698 - RNA, 18 nt, artificial
  Chemically synthesized
caggugacugcucggagu

SEQ ID NO: 3699 - RNA, 18 nt, artificial
  Chemically synthesized
gaacuugagauugaugcu

SEQ ID NO: 3700 - RNA, 18 nt, artificial
  Chemically synthesized
agcaggaacaucugcuau

SEQ ID NO: 3701 - RNA, 18 nt, artificial
  Chemically synthesized
acaucugcuaugaugcau

SEQ ID NO: 3702 - RNA, 18 nt, artificial
  Chemically synthesized
auccacaguugguugacu

SEQ ID NO: 3703 - RNA, 18 nt, artificial
  Chemically synthesized
aacuggacuucucccauu

SEQ ID NO: 3704 - RNA, 18 nt, artificial
  Chemically synthesized
ucagaacuauccacuggu

SEQ ID NO: 3705 - RNA, 18 nt, artificial
  Chemically synthesized
uugaaaagagccacaaaa

SEQ ID NO: 3706 - RNA, 18 nt, artificial
  Chemically synthesized
agucuugaacauuuagac

SEQ ID NO: 3707 - RNA, 18 nt, artificial
  Chemically synthesized
aauccuuacaaaacccua

SEQ ID NO: 3708 - RNA, 18 nt, artificial
  Chemically synthesized
ucuccaaggaagaauccu

SEQ ID NO: 3709 - RNA, 18 nt, artificial
  Chemically synthesized
gaauccuccaaucaggcu

SEQ ID NO: 3710 - RNA, 18 nt, artificial
  Chemically synthesized
gaucuuuaaacuccauuc

SEQ ID NO: 3711 - RNA, 18 nt, artificial
  Chemically synthesized
guauccaagggaauuggu

SEQ ID NO: 3712 - RNA, 18 nt, artificial
  Chemically synthesized
uccggaggcugcauauuc

SEQ ID NO: 3713 - RNA, 18 nt, artificial
  Chemically synthesized
cuuuaaacuccauucccu

SEQ ID NO: 3714 - RNA, 18 nt, artificial
  Chemically synthesized
agaggaagauucuuuuuc

SEQ ID NO: 3715 - RNA, 18 nt, artificial
  Chemically synthesized
ugauuggccagcaaauua

SEQ ID NO: 3716 - RNA, 18 nt, artificial
  Chemically synthesized
cugagagcugcgauaaag

SEQ ID NO: 3717 - RNA, 18 nt, artificial
  Chemically synthesized
ccacuggugaaacaaauu

SEQ ID NO: 3718 - RNA, 18 nt, artificial
  Chemically synthesized
agcacacgaauacacagu

SEQ ID NO: 3719 - RNA, 18 nt, artificial
  Chemically synthesized
ccaaaacuuguugcuauu

SEQ ID NO: 3720 - RNA, 18 nt, artificial
  Chemically synthesized
gaguugguaauuuuagag

SEQ ID NO: 3721 - RNA, 18 nt, artificial
  Chemically synthesized
gcucagcgggaaggauuu

SEQ ID NO: 3722 - RNA, 18 nt, artificial
  Chemically synthesized
gaaaaucaccgaugaaag

SEQ ID NO: 3723 - RNA, 18 nt, artificial
  Chemically synthesized
cuuaagauucucaaugac

SEQ ID NO: 3724 - RNA, 18 nt, artificial
  Chemically synthesized
gacuucauggaugcagaa

SEQ ID NO: 3725 - RNA, 18 nt, artificial
  Chemically synthesized
cgcaaugguaucugcaag

SEQ ID NO: 3726 - RNA, 18 nt, artificial
  Chemically synthesized
cucuguccuaccuagcug

SEQ ID NO: 3727 - RNA, 18 nt, artificial
  Chemically synthesized
cuuucacugcuuucaacu

SEQ ID NO: 3728 - RNA, 18 nt, artificial
  Chemically synthesized
uggacuuaccuuccuuga

SEQ ID NO: 3729 - RNA, 18 nt, artificial
  Chemically synthesized
accuacauuagcaacagu

SEQ ID NO: 3730 - RNA, 18 nt, artificial
  Chemically synthesized
uucccauauuuaagacca

SEQ ID NO: 3731 - RNA, 18 nt, artificial
  Chemically synthesized
caguaaaguuuuucuggu

SEQ ID NO: 3732 - RNA, 18 nt, artificial
  Chemically synthesized
caacaacaggaucaccua

SEQ ID NO: 3733 - RNA, 18 nt, artificial
  Chemically synthesized
gagcacuuuauauucacu

SEQ ID NO: 3734 - RNA, 18 nt, artificial
  Chemically synthesized
ugaucucaagagcaacaa

SEQ ID NO: 3735 - RNA, 18 nt, artificial
  Chemically synthesized
aaguuuuucugguuccuu

SEQ ID NO: 3736 - RNA, 18 nt, artificial
  Chemically synthesized
auacugauuuggacacuu

SEQ ID NO: 3737 - RNA, 18 nt, artificial
  Chemically synthesized
gauuuggacacuuuccau

SEQ ID NO: 3738 - RNA, 18 nt, artificial
  Chemically synthesized
uggcaugugcugugcucu

SEQ ID NO: 3739 - RNA, 18 nt, artificial
  Chemically synthesized
uagagcaucugauaauga

SEQ ID NO: 3740 - RNA, 18 nt, artificial
  Chemically synthesized
gugacucccaggagcucu

SEQ ID NO: 3741 - RNA, 18 nt, artificial
  Chemically synthesized
ggaagcccaggaaagcuc

SEQ ID NO: 3742 - RNA, 18 nt, artificial
  Chemically synthesized
aaaaauucagccugugag

SEQ ID NO: 3743 - RNA, 18 nt, artificial
  Chemically synthesized
agcaacuggcuuaguuca

SEQ ID NO: 3744 - RNA, 18 nt, artificial
  Chemically synthesized
uucauaugaagcagcaua

SEQ ID NO: 3745 - RNA, 18 nt, artificial
  Chemically synthesized
cucuuuuuucucaucuca

SEQ ID NO: 3746 - RNA, 18 nt, artificial
  Chemically synthesized
cgggaugccuacugggug

SEQ ID NO: 3747 - RNA, 18 nt, artificial
  Chemically synthesized
uacacaguguaacaggcu

SEQ ID NO: 3748 - RNA, 18 nt, artificial
  Chemically synthesized
cagcacaaaugaacuuaa

SEQ ID NO: 3749 - RNA, 18 nt, artificial
  Chemically synthesized
gacacuuuccauuuuuca

SEQ ID NO: 3750 - RNA, 18 nt, artificial
  Chemically synthesized
ggacuucucccauuuccg

SEQ ID NO: 3751 - RNA, 18 nt, artificial
  Chemically synthesized
uucauucuaugccugaaa

SEQ ID NO: 3752 - RNA, 18 nt, artificial
  Chemically synthesized
caccgaugaaaguuuguu

SEQ ID NO: 3753 - RNA, 18 nt, artificial
  Chemically synthesized
agcaaauuaccuguguga

SEQ ID NO: 3754 - RNA, 18 nt, artificial
  Chemically synthesized
cuugagauugaugcuuca

SEQ ID NO: 3755 - RNA, 18 nt, artificial
  Chemically synthesized
cuuuccauuuuucagaac

SEQ ID NO: 3756 - RNA, 18 nt, artificial
  Chemically synthesized
gacugcucggaguucucc

SEQ ID NO: 3757 - RNA, 18 nt, artificial
  Chemically synthesized
gcgggacuucauuccugg

SEQ ID NO: 3758 - RNA, 18 nt, artificial
  Chemically synthesized
gagcucuuagugaccaag

SEQ ID NO: 3759 - RNA, 18 nt, artificial
  Chemically synthesized
ccgucauuugaggacuug

SEQ ID NO: 3760 - RNA, 18 nt, artificial
  Chemically synthesized
aacugguaguuguggguu

SEQ ID NO: 3761 - RNA, 18 nt, artificial
  Chemically synthesized
cuccauugaaaagagcca

SEQ ID NO: 3762 - RNA, 18 nt, artificial
  Chemically synthesized
augacagaguuauagauc

SEQ ID NO: 3763 - RNA, 18 nt, artificial
  Chemically synthesized
gcauauuuuacugcugga

SEQ ID NO: 3764 - RNA, 18 nt, artificial
  Chemically synthesized
cuggacuucucccauuuc

SEQ ID NO: 3765 - RNA, 18 nt, artificial
  Chemically synthesized
cucccagcaggaacaucu

SEQ ID NO: 3766 - RNA, 18 nt, artificial
  Chemically synthesized
cuugaggaacuugagauu

SEQ ID NO: 3767 - RNA, 18 nt, artificial
  Chemically synthesized
uggacacuuuccauuuuu

SEQ ID NO: 3768 - RNA, 18 nt, artificial
  Chemically synthesized
gguauccaagggaauugg

SEQ ID NO: 3769 - RNA, 18 nt, artificial
  Chemically synthesized
gccagauuuaaaaauugg

SEQ ID NO: 3770 - RNA, 18 nt, artificial
  Chemically synthesized
uacccuuaauggaguugg

SEQ ID NO: 3771 - RNA, 18 nt, artificial
  Chemically synthesized
cuggugaaacaaauucau

SEQ ID NO: 3772 - RNA, 18 nt, artificial
  Chemically synthesized
ugaccgcaaugguaucug

SEQ ID NO: 3773 - RNA, 18 nt, artificial
  Chemically synthesized
ccaagggaauugguugca

SEQ ID NO: 3774 - RNA, 18 nt, artificial
  Chemically synthesized
aucagccucuccaaggaa

SEQ ID NO: 3775 - RNA, 18 nt, artificial
  Chemically synthesized
uggguaaaucugagagcu

SEQ ID NO: 3776 - RNA, 18 nt, artificial
  Chemically synthesized
ugguggcaauaacuucau

SEQ ID NO: 3777 - RNA, 18 nt, artificial
  Chemically synthesized
gaaugucacaggacagca

SEQ ID NO: 3778 - RNA, 18 nt, artificial
  Chemically synthesized
acccauguuacuaguauu

SEQ ID NO: 3779 - RNA, 18 nt, artificial
  Chemically synthesized
guucauuaggaaacagca

SEQ ID NO: 3780 - RNA, 18 nt, artificial
  Chemically synthesized
cuggagauuuuuguagau

SEQ ID NO: 3781 - RNA, 18 nt, artificial
  Chemically synthesized
agcaacaacaaucucaau

SEQ ID NO: 3782 - RNA, 18 nt, artificial
  Chemically synthesized
uucauuugcuccugugaa

SEQ ID NO: 3783 - RNA, 18 nt, artificial
  Chemically synthesized
gcucauugugcccauugc

SEQ ID NO: 3784 - RNA, 18 nt, artificial
  Chemically synthesized
ccaugugcguggccagca

SEQ ID NO: 3785 - RNA, 18 nt, artificial
  Chemically synthesized
ccaccguuuccauggccu

SEQ ID NO: 3786 - RNA, 18 nt, artificial
  Chemically synthesized
ccucuccaaggaagaauc

SEQ ID NO: 3787 - RNA, 18 nt, artificial
  Chemically synthesized
ucuggugcugacauccaa

SEQ ID NO: 3788 - RNA, 18 nt, artificial
  Chemically synthesized
uccuugaggaacuugaga

SEQ ID NO: 3789 - RNA, 18 nt, artificial
  Chemically synthesized
aggugacugcucggaguu

SEQ ID NO: 3790 - RNA, 18 nt, artificial
  Chemically synthesized
caagagcaacaaggcaaa

SEQ ID NO: 3791 - RNA, 18 nt, artificial
  Chemically synthesized
gaccaagugaagguaccu

SEQ ID NO: 3792 - RNA, 18 nt, artificial
  Chemically synthesized
ccagcagguucaggaugu

SEQ ID NO: 3793 - RNA, 18 nt, artificial
  Chemically synthesized
cggugucggaaugucaca

SEQ ID NO: 3794 - RNA, 18 nt, artificial
  Chemically synthesized
agcucaggaucuuuaaac

SEQ ID NO: 3795 - RNA, 18 nt, artificial
  Chemically synthesized
caguugguugacuucaug

SEQ ID NO: 3796 - RNA, 18 nt, artificial
  Chemically synthesized
gaugacucuaccagaugc

SEQ ID NO: 3797 - RNA, 18 nt, artificial
  Chemically synthesized
auccggaggcugcauauu

SEQ ID NO: 3798 - RNA, 18 nt, artificial
  Chemically synthesized
gaagauucuuuuucuucc

SEQ ID NO: 3799 - RNA, 18 nt, artificial
  Chemically synthesized
acuggacaaugccacaua

SEQ ID NO: 3800 - RNA, 18 nt, artificial
  Chemically synthesized
aguuuuucugguuccuug

SEQ ID NO: 3801 - RNA, 18 nt, artificial
  Chemically synthesized
cuucucccauuuccgucu

SEQ ID NO: 3802 - RNA, 18 nt, artificial
  Chemically synthesized
gaugccuggcccucucua

SEQ ID NO: 3803 - RNA, 18 nt, artificial
  Chemically synthesized
guaucugcaagggcagcu

SEQ ID NO: 3804 - RNA, 18 nt, artificial
  Chemically synthesized
caugugcugugcucuguu

SEQ ID NO: 3805 - RNA, 18 nt, artificial
  Chemically synthesized
accgaugaaaguuuguuu

SEQ ID NO: 3806 - RNA, 18 nt, artificial
  Chemically synthesized
ucuuagugaccaagugaa

SEQ ID NO: 3807 - RNA, 18 nt, artificial
  Chemically synthesized
gaaccuccaggcucuggu

SEQ ID NO: 3808 - RNA, 18 nt, artificial
  Chemically synthesized
cauuccuggcaaguggau

SEQ ID NO: 3809 - RNA, 18 nt, artificial
  Chemically synthesized
uuucuuccugcuaagaga

SEQ ID NO: 3810 - RNA, 18 nt, artificial
  Chemically synthesized
gaugcugccauucucauu

SEQ ID NO: 3811 - RNA, 18 nt, artificial
  Chemically synthesized
ucagaucuacagagcuau

SEQ ID NO: 3812 - RNA, 18 nt, artificial
  Chemically synthesized
uucuaaggagcaacuuga

SEQ ID NO: 3813 - RNA, 18 nt, artificial
  Chemically synthesized
cagugaccuacagaggug

SEQ ID NO: 3814 - RNA, 18 nt, artificial
  Chemically synthesized
cuguggccacaaaaggca

SEQ ID NO: 3815 - RNA, 18 nt, artificial
  Chemically synthesized
uaugaucugagcacuuua

SEQ ID NO: 3816 - RNA, 18 nt, artificial
  Chemically synthesized
cugcucggaguucuccca

SEQ ID NO: 3817 - RNA, 18 nt, artificial
  Chemically synthesized
caauaacuucauuugcuc

SEQ ID NO: 3818 - RNA, 18 nt, artificial
  Chemically synthesized
acuucauuccuggcaagu

SEQ ID NO: 3819 - RNA, 18 nt, artificial
  Chemically synthesized
uacuuuugauccacaguu

SEQ ID NO: 3820 - RNA, 18 nt, artificial
  Chemically synthesized
ccaggagcucuuagugac

SEQ ID NO: 3821 - RNA, 18 nt, artificial
  Chemically synthesized
ucggaaugucacaggaca

SEQ ID NO: 3822 - RNA, 18 nt, artificial
  Chemically synthesized
ggagcagcaagcacuggc

SEQ ID NO: 3823 - RNA, 18 nt, artificial
  Chemically synthesized
gcuuucugaaaacuuugu

SEQ ID NO: 3824 - RNA, 18 nt, artificial
  Chemically synthesized
aaaacuuguugcuauucc

SEQ ID NO: 3825 - RNA, 18 nt, artificial
  Chemically synthesized
uagcaacagugaccuaca

SEQ ID NO: 3826 - RNA, 18 nt, artificial
  Chemically synthesized
auuugaacuuauccagca

SEQ ID NO: 3827 - RNA, 18 nt, artificial
  Chemically synthesized
cgucauuugaggacuugc

SEQ ID NO: 3828 - RNA, 18 nt, artificial
  Chemically synthesized
ucaggugacugcucggag

SEQ ID NO: 3829 - RNA, 18 nt, artificial
  Chemically synthesized
aacuggcuuaguucauua

SEQ ID NO: 3830 - RNA, 18 nt, artificial
  Chemically synthesized
gucauucuuucuuccugc

SEQ ID NO: 3831 - RNA, 18 nt, artificial
  Chemically synthesized
gugcagcugaucucaaga

SEQ ID NO: 3832 - RNA, 18 nt, artificial
  Chemically synthesized
gacuucucccauuuccgu

SEQ ID NO: 3833 - RNA, 18 nt, artificial
  Chemically synthesized
agcuguaaaaagccuuga

SEQ ID NO: 3834 - RNA, 18 nt, artificial
  Chemically synthesized
cugcuggagauuuuugua

SEQ ID NO: 3835 - RNA, 18 nt, artificial
  Chemically synthesized
aggaacuugagauugaug

SEQ ID NO: 3836 - RNA, 18 nt, artificial
  Chemically synthesized
agauugaugcuucagauc

SEQ ID NO: 3837 - RNA, 18 nt, artificial
  Chemically synthesized
cuacagaggugugugaac

SEQ ID NO: 3838 - RNA, 18 nt, artificial
  Chemically synthesized
aggagaccuauagugacu

SEQ ID NO: 3839 - RNA, 18 nt, artificial
  Chemically synthesized
uagcaacaacaaucucaa

SEQ ID NO: 3840 - RNA, 18 nt, artificial
  Chemically synthesized
gacagaguuauagaucca

SEQ ID NO: 3841 - RNA, 18 nt, artificial
  Chemically synthesized
caaugguaucugcaaggg

SEQ ID NO: 3842 - RNA, 18 nt, artificial
  Chemically synthesized
gcugccauucucauucuu

SEQ ID NO: 3843 - RNA, 18 nt, artificial
  Chemically synthesized
ccauugcucuuucacugc

SEQ ID NO: 3844 - RNA, 18 nt, artificial
  Chemically synthesized
ccucccucuuacccaugu

SEQ ID NO: 3845 - RNA, 18 nt, artificial
  Chemically synthesized
ucaucugauccuucauau

SEQ ID NO: 3846 - RNA, 18 nt, artificial
  Chemically synthesized
cauauuccaagguuuuac

SEQ ID NO: 3847 - RNA, 18 nt, artificial
  Chemically synthesized
cacugcuuucaacuggua

SEQ ID NO: 3848 - RNA, 18 nt, artificial
  Chemically synthesized
aacuacguuuucuaagga

SEQ ID NO: 3849 - RNA, 18 nt, artificial
  Chemically synthesized
cugguggcaauaacuuca

SEQ ID NO: 3850 - RNA, 18 nt, artificial
  Chemically synthesized
uguuugguguugcaagca

SEQ ID NO: 3851 - RNA, 18 nt, artificial
  Chemically synthesized
ugcuaagagacuccucug

SEQ ID NO: 3852 - RNA, 18 nt, artificial
  Chemically synthesized
aaucauuuggcaucauug

SEQ ID NO: 3853 - RNA, 18 nt, artificial
  Chemically synthesized
aauucagccugugaggau

SEQ ID NO: 3854 - RNA, 18 nt, artificial
  Chemically synthesized
guacccuuaauggaguug

SEQ ID NO: 3855 - RNA, 18 nt, artificial
  Chemically synthesized
guggauggugugggucuu

SEQ ID NO: 3856 - RNA, 18 nt, artificial
  Chemically synthesized
caggaaagcucccagcag

SEQ ID NO: 3857 - RNA, 18 nt, artificial
  Chemically synthesized
caggcucuggugcugaca

SEQ ID NO: 3858 - RNA, 18 nt, artificial
  Chemically synthesized
aaccggagagacuuugcu

SEQ ID NO: 3859 - RNA, 18 nt, artificial
  Chemically synthesized
cauucuuaaacuuacugg

SEQ ID NO: 3860 - RNA, 18 nt, artificial
  Chemically synthesized
ugcuggacuuaccuuccu

SEQ ID NO: 3861 - RNA, 18 nt, artificial
  Chemically synthesized
agccacaaaacugucuuu

SEQ ID NO: 3862 - RNA, 18 nt, artificial
  Chemically synthesized
uucuaugccugaaacuug

SEQ ID NO: 3863 - RNA, 18 nt, artificial
  Chemically synthesized
cugcuuucaacugguagu

SEQ ID NO: 3864 - RNA, 18 nt, artificial
  Chemically synthesized
cacuggugucuggcaugu

SEQ ID NO: 3865 - RNA, 18 nt, artificial
  Chemically synthesized
uacugauuuggacacuuu

SEQ ID NO: 3866 - RNA, 18 nt, artificial
  Chemically synthesized
aaaagauuuugcuggacu

SEQ ID NO: 3867 - RNA, 18 nt, artificial
  Chemically synthesized
aauugcaaauccugagag

SEQ ID NO: 3868 - RNA, 18 nt, artificial
  Chemically synthesized
gugaccgcaaugguaucu

SEQ ID NO: 3869 - RNA, 18 nt, artificial
  Chemically synthesized
gagagcugcgauaaaguc

SEQ ID NO: 3870 - RNA, 18 nt, artificial
  Chemically synthesized
gacuuuggaagcuggugg

SEQ ID NO: 3871 - RNA, 18 nt, artificial
  Chemically synthesized
gucacuucucugugcagc

SEQ ID NO: 3872 - RNA, 18 nt, artificial
  Chemically synthesized
ugacugugucauucuuuc

SEQ ID NO: 3873 - RNA, 18 nt, artificial
  Chemically synthesized
ggugugugaaccuccagg

SEQ ID NO: 3874 - RNA, 18 nt, artificial
  Chemically synthesized
aauacacaguguaacagg

SEQ ID NO: 3875 - RNA, 18 nt, artificial
  Chemically synthesized
ugcauucccaagacacug

SEQ ID NO: 3876 - RNA, 18 nt, artificial
  Chemically synthesized
auguuuggaacugcgaga

SEQ ID NO: 3877 - RNA, 18 nt, artificial
  Chemically synthesized
cugcgagauacugauuug

SEQ ID NO: 3878 - RNA, 18 nt, artificial
  Chemically synthesized
aagagugaguggugcaag

SEQ ID NO: 3879 - RNA, 18 nt, artificial
  Chemically synthesized
caucauuggaaaaaaccg

SEQ ID NO: 3880 - RNA, 18 nt, artificial
  Chemically synthesized
acuacguggauguaccgu

SEQ ID NO: 3881 - RNA, 18 nt, artificial
  Chemically synthesized
guuaaguucauucagaca

SEQ ID NO: 3882 - RNA, 18 nt, artificial
  Chemically synthesized
ggccagcaaauuaccugu

SEQ ID NO: 3883 - RNA, 18 nt, artificial
  Chemically synthesized
gaucucaagagcaacaag

SEQ ID NO: 3884 - RNA, 18 nt, artificial
  Chemically synthesized
aagugaagguaccugugg

SEQ ID NO: 3885 - RNA, 18 nt, artificial
  Chemically synthesized
uugggaucuuuaugucac

SEQ ID NO: 3886 - RNA, 18 nt, artificial
  Chemically synthesized
cuacuggguggagaaccu

SEQ ID NO: 3887 - RNA, 18 nt, artificial
  Chemically synthesized
ucuuugaauuugccgcaa

SEQ ID NO: 3888 - RNA, 18 nt, artificial
  Chemically synthesized
agauucucaaugacugug

SEQ ID NO: 3889 - RNA, 18 nt, artificial
  Chemically synthesized
accaagugaagguaccug

SEQ ID NO: 3890 - RNA, 18 nt, artificial
  Chemically synthesized
acaacaggaucaccuaca

SEQ ID NO: 3891 - RNA, 18 nt, artificial
  Chemically synthesized
guguaacaggcugcauuc

SEQ ID NO: 3892 - RNA, 18 nt, artificial
  Chemically synthesized
gcagguucaggauguccg

SEQ ID NO: 3893 - RNA, 18 nt, artificial
  Chemically synthesized
cucuccuucacucaggag

SEQ ID NO: 3894 - RNA, 18 nt, artificial
  Chemically synthesized
gucccuugguauccaagg

SEQ ID NO: 3895 - RNA, 18 nt, artificial
  Chemically synthesized
ugcuuucugaaaacuuug

SEQ ID NO: 3896 - RNA, 18 nt, artificial
  Chemically synthesized
acacaguguaacaggcug

SEQ ID NO: 3897 - RNA, 18 nt, artificial
  Chemically synthesized
aaucaccgaugaaaguuu

SEQ ID NO: 3898 - RNA, 18 nt, artificial
  Chemically synthesized
auugcucuuucacugcuu

SEQ ID NO: 3899 - RNA, 18 nt, artificial
  Chemically synthesized
gcacuggugucuggcaug

SEQ ID NO: 3900 - RNA, 18 nt, artificial
  Chemically synthesized
uguaaucuguagcaacug

SEQ ID NO: 3901 - RNA, 18 nt, artificial
  Chemically synthesized
acaaguuccguggaaugu

SEQ ID NO: 3902 - RNA, 18 nt, artificial
  Chemically synthesized
ccuggaguggcccaugga

SEQ ID NO: 3903 - RNA, 18 nt, artificial
  Chemically synthesized
uaguugggaucuuuaugu

SEQ ID NO: 3904 - RNA, 18 nt, artificial
  Chemically synthesized
cagcgcuucugcaagcug

SEQ ID NO: 3905 - RNA, 18 nt, artificial
  Chemically synthesized
ccguuuccauggccugug

SEQ ID NO: 3906 - RNA, 18 nt, artificial
  Chemically synthesized
agcacuggccaaagucuu

SEQ ID NO: 3907 - RNA, 18 nt, artificial
  Chemically synthesized
ugucggaaugucacagga

SEQ ID NO: 3908 - RNA, 18 nt, artificial
  Chemically synthesized
ucuucuggagcccauuga

SEQ ID NO: 3909 - RNA, 18 nt, artificial
  Chemically synthesized
auuuggacacuuuccauu

SEQ ID NO: 3910 - RNA, 18 nt, artificial
  Chemically synthesized
gcgggaugccuacugggu

SEQ ID NO: 3911 - RNA, 18 nt, artificial
  Chemically synthesized
aauccuccaaucaggcuu

SEQ ID NO: 3912 - RNA, 18 nt, artificial
  Chemically synthesized
acugcuuucaacugguag

SEQ ID NO: 3913 - RNA, 18 nt, artificial
  Chemically synthesized
ccuccaggcucuggugcu

SEQ ID NO: 3914 - RNA, 18 nt, artificial
  Chemically synthesized
uugcaaauccugagagug

SEQ ID NO: 3915 - RNA, 18 nt, artificial
  Chemically synthesized
gaggcucagcgggaagga

SEQ ID NO: 3916 - RNA, 18 nt, artificial
  Chemically synthesized
ucuuccugcuaagagacu

SEQ ID NO: 3917 - RNA, 18 nt, artificial
  Chemically synthesized
uuuuacugcuggagauuu

SEQ ID NO: 3918 - RNA, 18 nt, artificial
  Chemically synthesized
auacuuuguggauggugu

SEQ ID NO: 3919 - RNA, 18 nt, artificial
  Chemically synthesized
guaccgucauuugaggac

SEQ ID NO: 3920 - RNA, 18 nt, artificial
  Chemically synthesized
cagaaauaaguugaugac

SEQ ID NO: 3921 - RNA, 18 nt, artificial
  Chemically synthesized
cagcacuggugucuggca

SEQ ID NO: 3922 - RNA, 18 nt, artificial
  Chemically synthesized
cucaggagcagcaagcac

SEQ ID NO: 3923 - RNA, 18 nt, artificial
  Chemically synthesized
uugucaguggccagaaaa

SEQ ID NO: 3924 - RNA, 18 nt, artificial
  Chemically synthesized
gaagacuuuggaagcugg

SEQ ID NO: 3925 - RNA, 18 nt, artificial
  Chemically synthesized
cuuuguggaugguguggg

SEQ ID NO: 3926 - RNA, 18 nt, artificial
  Chemically synthesized
auaaugaacaccaagacc

SEQ ID NO: 3927 - RNA, 18 nt, artificial
  Chemically synthesized
aaugaacaccaagaccua

SEQ ID NO: 3928 - RNA, 18 nt, artificial
  Chemically synthesized
uccaaaggagaccuauag

SEQ ID NO: 3929 - RNA, 18 nt, artificial
  Chemically synthesized
cugggcagucuugaacau

SEQ ID NO: 3930 - RNA, 18 nt, artificial
  Chemically synthesized
uggguggagaaccuuaug

SEQ ID NO: 3931 - RNA, 18 nt, artificial
  Chemically synthesized
uguaagucaucugauccu

SEQ ID NO: 3932 - RNA, 18 nt, artificial
  Chemically synthesized
ccugugugacucuccauc

SEQ ID NO: 3933 - RNA, 18 nt, artificial
  Chemically synthesized
agaagcuguaaaaagccu

SEQ ID NO: 3934 - RNA, 18 nt, artificial
  Chemically synthesized
aacuuugugaagagugag

SEQ ID NO: 3935 - RNA, 18 nt, artificial
  Chemically synthesized
ugaugcugccauucucau

SEQ ID NO: 3936 - RNA, 18 nt, artificial
  Chemically synthesized
aauccugagagugggaaa

SEQ ID NO: 3937 - RNA, 18 nt, artificial
  Chemically synthesized
acuggacuucucccauuu

SEQ ID NO: 3938 - RNA, 18 nt, artificial
  Chemically synthesized
gaaacagcacaaaugaac

SEQ ID NO: 3939 - RNA, 18 nt, artificial
  Chemically synthesized
ugagccaaaaaguuugaa

SEQ ID NO: 3940 - RNA, 18 nt, artificial
  Chemically synthesized
ugacaauaucauugacuc

SEQ ID NO: 3941 - RNA, 18 nt, artificial
  Chemically synthesized
cgucuuccugguucaagc

SEQ ID NO: 3942 - RNA, 18 nt, artificial
  Chemically synthesized
ugcccauugcucuuucac

SEQ ID NO: 3943 - RNA, 18 nt, artificial
  Chemically synthesized
uggcaaguggaucauuga

SEQ ID NO: 3944 - RNA, 18 nt, artificial
  Chemically synthesized
guccuaccuagcugucac

SEQ ID NO: 3945 - RNA, 18 nt, artificial
  Chemically synthesized
uggcaauaacuucauuug

SEQ ID NO: 3946 - RNA, 18 nt, artificial
  Chemically synthesized
ugacucauuucacacacu

SEQ ID NO: 3947 - RNA, 18 nt, artificial
  Chemically synthesized
cguucucucaggugacug

SEQ ID NO: 3948 - RNA, 18 nt, artificial
  Chemically synthesized
aacuuguugcuauuccua

SEQ ID NO: 3949 - RNA, 18 nt, artificial
  Chemically synthesized
uuaccuuccuugaggaac

SEQ ID NO: 3950 - RNA, 18 nt, artificial
  Chemically synthesized
cuggccaaagucuugauu

SEQ ID NO: 3951 - RNA, 18 nt, artificial
  Chemically synthesized
ucaccuacauuagcaaca

SEQ ID NO: 3952 - RNA, 18 nt, artificial
  Chemically synthesized
ucauggaugcagaaccca

SEQ ID NO: 3953 - RNA, 18 nt, artificial
  Chemically synthesized
gugcugugcucuguuccu

SEQ ID NO: 3954 - RNA, 18 nt, artificial
  Chemically synthesized
aagucaucugauccuuca

SEQ ID NO: 3955 - RNA, 18 nt, artificial
  Chemically synthesized
ucauucuucuggagccca

SEQ ID NO: 3956 - RNA, 18 nt, artificial
  Chemically synthesized
aaacuuugugaagaguga

SEQ ID NO: 3957 - RNA, 18 nt, artificial
  Chemically synthesized
gccagcaaauuaccugug

SEQ ID NO: 3958 - RNA, 18 nt, artificial
  Chemically synthesized
gucauuugaggacuugcu

SEQ ID NO: 3959 - RNA, 18 nt, artificial
  Chemically synthesized
gacuucauuccuggcaag

SEQ ID NO: 3960 - RNA, 18 nt, artificial
  Chemically synthesized
gcucccagcaggaacauc

SEQ ID NO: 3961 - RNA, 18 nt, artificial
  Chemically synthesized
caaaacuuguugcuauuc

SEQ ID NO: 3962 - RNA, 18 nt, artificial
  Chemically synthesized
cucauugugcccauugcu

SEQ ID NO: 3963 - RNA, 18 nt, artificial
  Chemically synthesized
gagggccaacuguaaucu

SEQ ID NO: 3964 - RNA, 18 nt, artificial
  Chemically synthesized
acuggugucuggcaugug

SEQ ID NO: 3965 - RNA, 18 nt, artificial
  Chemically synthesized
ggaguggcccauggacga

SEQ ID NO: 3966 - RNA, 18 nt, artificial
  Chemically synthesized
gauguuacaaguuccgug

SEQ ID NO: 3967 - RNA, 18 nt, artificial
  Chemically synthesized
aggaagcccaggaaagcu

SEQ ID NO: 3968 - RNA, 18 nt, artificial
  Chemically synthesized
cagggcucacagaagcug

SEQ ID NO: 3969 - RNA, 18 nt, artificial
  Chemically synthesized
gauuggccagcaaauuac

SEQ ID NO: 3970 - RNA, 18 nt, artificial
  Chemically synthesized
uugguugacuucauggau

SEQ ID NO: 3971 - RNA, 18 nt, artificial
  Chemically synthesized
acugauuuggacacuuuc

SEQ ID NO: 3972 - RNA, 18 nt, artificial
  Chemically synthesized
gcugcgauaaaguccuag

SEQ ID NO: 3973 - RNA, 18 nt, artificial
  Chemically synthesized
cucguggauaucaaaauu

SEQ ID NO: 3974 - RNA, 18 nt, artificial
  Chemically synthesized
gucuugugaccgcaaugg

SEQ ID NO: 3975 - RNA, 18 nt, artificial
  Chemically synthesized
aguuccguggaauguuug

SEQ ID NO: 3976 - RNA, 18 nt, artificial
  Chemically synthesized
ugauuuggacacuuucca

SEQ ID NO: 3977 - RNA, 18 nt, artificial
  Chemically synthesized
caagugaagguaccugug

SEQ ID NO: 3978 - RNA, 18 nt, artificial
  Chemically synthesized
agggcagcucaggaucuu

SEQ ID NO: 3979 - RNA, 18 nt, artificial
  Chemically synthesized
cuuagugaccaagugaag

SEQ ID NO: 3980 - RNA, 18 nt, artificial
  Chemically synthesized
uuacaaguuccguggaau

SEQ ID NO: 3981 - RNA, 18 nt, artificial
  Chemically synthesized
ugagagcugcgauaaagu

SEQ ID NO: 3982 - RNA, 18 nt, artificial
  Chemically synthesized
ugaaaacuuugugaagag

SEQ ID NO: 3983 - RNA, 18 nt, artificial
  Chemically synthesized
cagaggugugugaaccuc

SEQ ID NO: 3984 - RNA, 18 nt, artificial
  Chemically synthesized
ucuucauaagcgggacuu

SEQ ID NO: 3985 - RNA, 18 nt, artificial
  Chemically synthesized
acaaaaggcauucucugu

SEQ ID NO: 3986 - RNA, 18 nt, artificial
  Chemically synthesized
ucccaguguuugguguug

SEQ ID NO: 3987 - RNA, 18 nt, artificial
  Chemically synthesized
ucugucuugugaccgcaa

SEQ ID NO: 3988 - RNA, 18 nt, artificial
  Chemically synthesized
cugugccaccguuuccau

SEQ ID NO: 3989 - RNA, 18 nt, artificial
  Chemically synthesized
cagcucaggaucuuuaaa

SEQ ID NO: 3990 - RNA, 18 nt, artificial
  Chemically synthesized
cagcauauuuuacugcug

SEQ ID NO: 3991 - RNA, 18 nt, artificial
  Chemically synthesized
aggacagcacuggugucu

SEQ ID NO: 3992 - RNA, 18 nt, artificial
  Chemically synthesized
guccaggagcuggagaac

SEQ ID NO: 3993 - RNA, 18 nt, artificial
  Chemically synthesized
ccuuaugguccaggagcu

SEQ ID NO: 3994 - RNA, 18 nt, artificial
  Chemically synthesized
acuggugaaacaaauuca

SEQ ID NO: 3995 - RNA, 18 nt, artificial
  Chemically synthesized
cuagcugucacuucucug

SEQ ID NO: 3996 - RNA, 18 nt, artificial
  Chemically synthesized
gaggugugugaaccucca

SEQ ID NO: 3997 - RNA, 18 nt, artificial
  Chemically synthesized
gguaucugcaagggcagc

SEQ ID NO: 3998 - RNA, 18 nt, artificial
  Chemically synthesized
uggaauguuuggaacugc

SEQ ID NO: 3999 - RNA, 18 nt, artificial
  Chemically synthesized
uggacaaugccacauacu

SEQ ID NO: 4000 - RNA, 18 nt, artificial
  Chemically synthesized
cuccuucacucaggagca

SEQ ID NO: 4001 - RNA, 18 nt, artificial
  Chemically synthesized
uguagcaacuggcuuagu

SEQ ID NO: 4002 - RNA, 18 nt, artificial
  Chemically synthesized
uaccuagcugucacuucu

SEQ ID NO: 4003 - RNA, 18 nt, artificial
  Chemically synthesized
ugcuaugaugcauuuguu

SEQ ID NO: 4004 - RNA, 18 nt, artificial
  Chemically synthesized
ucucugugcagcugaucu

SEQ ID NO: 4005 - RNA, 18 nt, artificial
  Chemically synthesized
auccaagggaauugguug

SEQ ID NO: 4006 - RNA, 18 nt, artificial
  Chemically synthesized
uugacuccauugaaaaga

SEQ ID NO: 4007 - RNA, 18 nt, artificial
  Chemically synthesized
gucuugauugauuggcca

SEQ ID NO: 4008 - RNA, 18 nt, artificial
  Chemically synthesized
ucauaugaagcagcauau

SEQ ID NO: 4009 - RNA, 18 nt, artificial
  Chemically synthesized
aaaaccggagagacuuug

SEQ ID NO: 4010 - RNA, 18 nt, artificial
  Chemically synthesized
gcccauggacgaggcuca

SEQ ID NO: 4011 - RNA, 18 nt, artificial
  Chemically synthesized
aauauagucccuugguau

SEQ ID NO: 4012 - RNA, 18 nt, artificial
  Chemically synthesized
caggaucuuuaaacucca

SEQ ID NO: 4013 - RNA, 18 nt, artificial
  Chemically synthesized
uauccaagggaauugguu

SEQ ID NO: 4014 - RNA, 18 nt, artificial
  Chemically synthesized
cuuacagugagcgggaug

SEQ ID NO: 4015 - RNA, 18 nt, artificial
  Chemically synthesized
ccugugccaccguuucca

SEQ ID NO: 4016 - RNA, 18 nt, artificial
  Chemically synthesized
gcucuguuccugcugauc

SEQ ID NO: 4017 - RNA, 18 nt, artificial
  Chemically synthesized
gcaaugguaucugcaagg

SEQ ID NO: 4018 - RNA, 18 nt, artificial
  Chemically synthesized
ccaaucaggcuucucugu

SEQ ID NO: 4019 - RNA, 18 nt, artificial
  Chemically synthesized
acugaagacuuuggaagc

SEQ ID NO: 4020 - RNA, 18 nt, artificial
  Chemically synthesized
ccuggcuccaggccaaaa

SEQ ID NO: 4021 - RNA, 18 nt, artificial
  Chemically synthesized
ugaaaagagccacaaaac

SEQ ID NO: 4022 - RNA, 18 nt, artificial
  Chemically synthesized
gugccaccguuuccaugg

SEQ ID NO: 4023 - RNA, 18 nt, artificial
  Chemically synthesized
ggcagcgagaaagcgcag

SEQ ID NO: 4024 - RNA, 18 nt, artificial
  Chemically synthesized
cagccugugaggaugccu

SEQ ID NO: 4025 - RNA, 18 nt, artificial
  Chemically synthesized
aggcagcgagaaagcgca

SEQ ID NO: 4026 - RNA, 18 nt, artificial
  Chemically synthesized
ggccagcagguucaggau

SEQ ID NO: 4027 - RNA, 18 nt, artificial
  Chemically synthesized
cuccugugaauuccucuc

SEQ ID NO: 4028 - RNA, 18 nt, artificial
  Chemically synthesized
uggugucuggcaugugcu

SEQ ID NO: 4029 - RNA, 18 nt, artificial
  Chemically synthesized
uugaugagaacaaugaug

SEQ ID NO: 4030 - RNA, 18 nt, artificial
  Chemically synthesized
guccugugccaccguuuc

SEQ ID NO: 4031 - RNA, 18 nt, artificial
  Chemically synthesized
cuggugucuggcaugugc

SEQ ID NO: 4032 - RNA, 18 nt, artificial
  Chemically synthesized
aggauguccgccucucgg

SEQ ID NO: 4033 - RNA, 18 nt, artificial
  Chemically synthesized
caggaacaucugcuauga

SEQ ID NO: 4034 - RNA, 18 nt, artificial
  Chemically synthesized
uccacuggugaaacaaau

SEQ ID NO: 4035 - RNA, 18 nt, artificial
  Chemically synthesized
cagccaggcggcugcucg

SEQ ID NO: 4036 - RNA, 18 nt, artificial
  Chemically synthesized
uccucuguggccacaaaa

SEQ ID NO: 4037 - RNA, 18 nt, artificial
  Chemically synthesized
uggugcaaguaugaacug

SEQ ID NO: 4038 - RNA, 18 nt, artificial
  Chemically synthesized
agggccaacuguaaucug

SEQ ID NO: 4039 - RNA, 18 nt, artificial
  Chemically synthesized
auuuuacugcuggagauu

SEQ ID NO: 4040 - RNA, 18 nt, artificial
  Chemically synthesized
caagggcagcucaggauc

SEQ ID NO: 4041 - RNA, 18 nt, artificial
  Chemically synthesized
uugugaccgcaaugguau

SEQ ID NO: 4042 - RNA, 18 nt, artificial
  Chemically synthesized
auuugcuccugugaauuc

SEQ ID NO: 4043 - RNA, 18 nt, artificial
  Chemically synthesized
gcuguaaaaagccuugac

SEQ ID NO: 4044 - RNA, 18 nt, artificial
  Chemically synthesized
cuguaaaaagccuugacc

SEQ ID NO: 4045 - RNA, 18 nt, artificial
  Chemically synthesized
ugccuacuggguggagaa

SEQ ID NO: 4046 - RNA, 18 nt, artificial
  Chemically synthesized
aaauugcaaauccugaga

SEQ ID NO: 4047 - RNA, 18 nt, artificial
  Chemically synthesized
acagaguuauagauccag

SEQ ID NO: 4048 - RNA, 18 nt, artificial
  Chemically synthesized
gaacaccaagaccuaccu

SEQ ID NO: 4049 - RNA, 18 nt, artificial
  Chemically synthesized
uucagaucuacagagcua

SEQ ID NO: 4050 - RNA, 18 nt, artificial
  Chemically synthesized
acugucuuugugcuuucu

SEQ ID NO: 4051 - RNA, 18 nt, artificial
  Chemically synthesized
ccaggaaagcucccagca

SEQ ID NO: 4052 - RNA, 18 nt, artificial
  Chemically synthesized
guucucccaguguuuggu

SEQ ID NO: 4053 - RNA, 18 nt, artificial
  Chemically synthesized
auuucacacacugaagac

SEQ ID NO: 4054 - RNA, 18 nt, artificial
  Chemically synthesized
ugguauccaagggaauug

SEQ ID NO: 4055 - RNA, 18 nt, artificial
  Chemically synthesized
cugaaacuugucaguggc

SEQ ID NO: 4056 - RNA, 18 nt, artificial
  Chemically synthesized
aaguggaaacguuaacaa

SEQ ID NO: 4057 - RNA, 18 nt, artificial
  Chemically synthesized
cagaagcuguaaaaagcc

SEQ ID NO: 4058 - RNA, 18 nt, artificial
  Chemically synthesized
ucccaagacacuggaaau

SEQ ID NO: 4059 - RNA, 18 nt, artificial
  Chemically synthesized
ugaaucagauuucuggau

SEQ ID NO: 4060 - RNA, 18 nt, artificial
  Chemically synthesized
ucacacacugaagacuuu

SEQ ID NO: 4061 - RNA, 18 nt, artificial
  Chemically synthesized
uugagaaaaaagccauuc

SEQ ID NO: 4062 - RNA, 18 nt, artificial
  Chemically synthesized
agaaaugugaaaaucacc

SEQ ID NO: 4063 - RNA, 18 nt, artificial
  Chemically synthesized
auucuucuggagcccauu

SEQ ID NO: 4064 - RNA, 18 nt, artificial
  Chemically synthesized
cuuaaacuuacugggaaa

SEQ ID NO: 4065 - RNA, 18 nt, artificial
  Chemically synthesized
uuuucuaaggagcaacuu

SEQ ID NO: 4066 - RNA, 18 nt, artificial
  Chemically synthesized
ucucccaguguuuggugu

SEQ ID NO: 4067 - RNA, 18 nt, artificial
  Chemically synthesized
agugaagguaccuguggg

SEQ ID NO: 4068 - RNA, 18 nt, artificial
  Chemically synthesized
uucauaagcgggacuuca

SEQ ID NO: 4069 - RNA, 18 nt, artificial
  Chemically synthesized
aaaagugcuguguauuuc

SEQ ID NO: 4070 - RNA, 18 nt, artificial
  Chemically synthesized
acauacuuuugauccaca

SEQ ID NO: 4071 - RNA, 18 nt, artificial
  Chemically synthesized
augccucccucuuaccca

SEQ ID NO: 4072 - RNA, 18 nt, artificial
  Chemically synthesized
aagcgggacuucauuccu

SEQ ID NO: 4073 - RNA, 18 nt, artificial
  Chemically synthesized
gaggaugccuggcccucu

SEQ ID NO: 4074 - RNA, 18 nt, artificial
  Chemically synthesized
gugcccauugcucuuuca

SEQ ID NO: 4075 - RNA, 18 nt, artificial
  Chemically synthesized
aaaagagccacaaaacug

SEQ ID NO: 4076 - RNA, 18 nt, artificial
  Chemically synthesized
aaucaggcuucucugucu

SEQ ID NO: 4077 - RNA, 18 nt, artificial
  Chemically synthesized
gacucccaggagcucuua

SEQ ID NO: 4078 - RNA, 18 nt, artificial
  Chemically synthesized
guuucagguuaugaaacu

SEQ ID NO: 4079 - RNA, 18 nt, artificial
  Chemically synthesized
cucaggaucuuuaaacuc

SEQ ID NO: 4080 - RNA, 18 nt, artificial
  Chemically synthesized
ugcugauccugcucacgg

SEQ ID NO: 4081 - RNA, 18 nt, artificial
  Chemically synthesized
ugcugccauucucauucu

SEQ ID NO: 4082 - RNA, 18 nt, artificial
  Chemically synthesized
gccauucucauucuucug

SEQ ID NO: 4083 - RNA, 18 nt, artificial
  Chemically synthesized
aaaaaccggagagacuuu

SEQ ID NO: 4084 - RNA, 18 nt, artificial
  Chemically synthesized
uuucacacacugaagacu

SEQ ID NO: 4085 - RNA, 18 nt, artificial
  Chemically synthesized
aagucuugauugauuggc

SEQ ID NO: 4086 - RNA, 18 nt, artificial
  Chemically synthesized
agauacugauuuggacac

SEQ ID NO: 4087 - RNA, 18 nt, artificial
  Chemically synthesized
acaauagaggaagauucu

SEQ ID NO: 4088 - RNA, 18 nt, artificial
  Chemically synthesized
aacuauccacuggugaaa

SEQ ID NO: 4089 - RNA, 18 nt, artificial
  Chemically synthesized
uugcaagcaggauccaaa

SEQ ID NO: 4090 - RNA, 18 nt, artificial
  Chemically synthesized
guugacuucauggaugca

SEQ ID NO: 4091 - RNA, 18 nt, artificial
  Chemically synthesized
aagauuuugcuggacuua

SEQ ID NO: 4092 - RNA, 18 nt, artificial
  Chemically synthesized
ccauggccugugguauau

SEQ ID NO: 4093 - RNA, 18 nt, artificial
  Chemically synthesized
uaguuuucauucuaugcc

SEQ ID NO: 4094 - RNA, 18 nt, artificial
  Chemically synthesized
cagcaagcacuggccaaa

SEQ ID NO: 4095 - RNA, 18 nt, artificial
  Chemically synthesized
guggccacaaaaggcauu

SEQ ID NO: 4096 - RNA, 18 nt, artificial
  Chemically synthesized
uugugaagagugaguggu

SEQ ID NO: 4097 - RNA, 18 nt, artificial
  Chemically synthesized
guuuucuaaggagcaacu

SEQ ID NO: 4098 - RNA, 18 nt, artificial
  Chemically synthesized
gcagcgagaaagcgcagc

SEQ ID NO: 4099 - RNA, 18 nt, artificial
  Chemically synthesized
ugaccaagugaagguacc

SEQ ID NO: 4100 - RNA, 18 nt, artificial
  Chemically synthesized
aaaacugucuuugugcuu

SEQ ID NO: 4101 - RNA, 18 nt, artificial
  Chemically synthesized
cuggcaugugcugugcuc

SEQ ID NO: 4102 - RNA, 18 nt, artificial
  Chemically synthesized
gagaaagcgcagccaggc

SEQ ID NO: 4103 - RNA, 18 nt, artificial
  Chemically synthesized
cacucugaaaaacuugac

SEQ ID NO: 4104 - RNA, 18 nt, artificial
  Chemically synthesized
aacuugacucauuucaca

SEQ ID NO: 4105 - RNA, 18 nt, artificial
  Chemically synthesized
cgagaaagcgcagccagg

SEQ ID NO: 4106 - RNA, 18 nt, artificial
  Chemically synthesized
gcugugcucuguuccugc

SEQ ID NO: 4107 - RNA, 18 nt, artificial
  Chemically synthesized
aagccuugaccuguccaa

SEQ ID NO: 4108 - RNA, 18 nt, artificial
  Chemically synthesized
uggacuucucccauuucc

SEQ ID NO: 4109 - RNA, 18 nt, artificial
  Chemically synthesized
aaaggaagcccaggaaag

SEQ ID NO: 4110 - RNA, 18 nt, artificial
  Chemically synthesized
uuaagaccagucuuuguc

SEQ ID NO: 4111 - RNA, 18 nt, artificial
  Chemically synthesized
gagaccuauagugacucc

SEQ ID NO: 4112 - RNA, 18 nt, artificial
  Chemically synthesized
gcguucucucaggugacu

SEQ ID NO: 4113 - RNA, 18 nt, artificial
  Chemically synthesized
aucugcaagggcagcuca

SEQ ID NO: 4114 - RNA, 18 nt, artificial
  Chemically synthesized
uccugcuaagagacuccu

SEQ ID NO: 4115 - RNA, 18 nt, artificial
  Chemically synthesized
acaguguaacaggcugca

SEQ ID NO: 4116 - RNA, 18 nt, artificial
  Chemically synthesized
aggaaugcaauaacuacg

SEQ ID NO: 4117 - RNA, 18 nt, artificial
  Chemically synthesized
ucccauauuuaagaccag

SEQ ID NO: 4118 - RNA, 18 nt, artificial
  Chemically synthesized
aucucaagagcaacaagg

SEQ ID NO: 4119 - RNA, 18 nt, artificial
  Chemically synthesized
uacauuagcaacagugac

SEQ ID NO: 4120 - RNA, 18 nt, artificial
  Chemically synthesized
ucauuugcuccugugaau

SEQ ID NO: 4121 - RNA, 18 nt, artificial
  Chemically synthesized
ugcucggcguucucucag

SEQ ID NO: 4122 - RNA, 18 nt, artificial
  Chemically synthesized
guuuuucugguuccuugu

SEQ ID NO: 4123 - RNA, 18 nt, artificial
  Chemically synthesized
uccguggaauguuuggaa

SEQ ID NO: 4124 - RNA, 18 nt, artificial
  Chemically synthesized
ucaguggccagaaaagau

SEQ ID NO: 4125 - RNA, 18 nt, artificial
  Chemically synthesized
auugguugcaggauccuc

SEQ ID NO: 4126 - RNA, 18 nt, artificial
  Chemically synthesized
uaagauucucaaugacug

SEQ ID NO: 4127 - RNA, 18 nt, artificial
  Chemically synthesized
cggaggcagcgagaaagc

SEQ ID NO: 4128 - RNA, 18 nt, artificial
  Chemically synthesized
acaaaacugucuuugugc

SEQ ID NO: 4129 - RNA, 18 nt, artificial
  Chemically synthesized
uuuggaacugcgagauac

SEQ ID NO: 4130 - RNA, 18 nt, artificial
  Chemically synthesized
aacugcgagauacugauu

SEQ ID NO: 4131 - RNA, 18 nt, artificial
  Chemically synthesized
ugaccuacagaggugugu

SEQ ID NO: 4132 - RNA, 18 nt, artificial
  Chemically synthesized
caaaacugucuuugugcu

SEQ ID NO: 4133 - RNA, 18 nt, artificial
  Chemically synthesized
acuuugugaagagugagu

SEQ ID NO: 4134 - RNA, 18 nt, artificial
  Chemically synthesized
aacaggcugcauucccaa

SEQ ID NO: 4135 - RNA, 18 nt, artificial
  Chemically synthesized
ggugucuggcaugugcug

SEQ ID NO: 4136 - RNA, 18 nt, artificial
  Chemically synthesized
gccaccguuuccauggcc

SEQ ID NO: 4137 - RNA, 18 nt, artificial
  Chemically synthesized
ugauccacaguugguuga

SEQ ID NO: 4138 - RNA, 18 nt, artificial
  Chemically synthesized
agcgcuucugcaagcugc

SEQ ID NO: 4139 - RNA, 18 nt, artificial
  Chemically synthesized
auucacuuacagaaagag

SEQ ID NO: 4140 - RNA, 18 nt, artificial
  Chemically synthesized
uuuaagaccagucuuugu

SEQ ID NO: 4141 - RNA, 18 nt, artificial
  Chemically synthesized
ucuuuaaacuccauuccc

SEQ ID NO: 4142 - RNA, 18 nt, artificial
  Chemically synthesized
cucccaggagcucuuagu

SEQ ID NO: 4143 - RNA, 18 nt, artificial
  Chemically synthesized
cagaguuauagauccagg

SEQ ID NO: 4144 - RNA, 18 nt, artificial
  Chemically synthesized
cuagaaaaaagugcugug

SEQ ID NO: 4145 - RNA, 18 nt, artificial
  Chemically synthesized
uaccgucauuugaggacu

SEQ ID NO: 4146 - RNA, 18 nt, artificial
  Chemically synthesized
acuuauccagcacacgaa

SEQ ID NO: 4147 - RNA, 18 nt, artificial
  Chemically synthesized
uguccaacaacaggauca

SEQ ID NO: 4148 - RNA, 18 nt, artificial
  Chemically synthesized
ugugaagagugaguggug

SEQ ID NO: 4149 - RNA, 18 nt, artificial
  Chemically synthesized
acccauggauauagaggg

SEQ ID NO: 4150 - RNA, 18 nt, artificial
  Chemically synthesized
caacaggaucaccuacau

SEQ ID NO: 4151 - RNA, 18 nt, artificial
  Chemically synthesized
cucuguggccacaaaagg

SEQ ID NO: 4152 - RNA, 18 nt, artificial
  Chemically synthesized
ucauaagcgggacuucau

SEQ ID NO: 4153 - RNA, 18 nt, artificial
  Chemically synthesized
aaauuuucacugagaucc

SEQ ID NO: 4154 - RNA, 18 nt, artificial
  Chemically synthesized
agaggcugaugaugaccc

SEQ ID NO: 4155 - RNA, 18 nt, artificial
  Chemically synthesized
uugccaggaaugaagucc

SEQ ID NO: 4156 - RNA, 18 nt, artificial
  Chemically synthesized
aaguuuguagagagggcc

SEQ ID NO: 4157 - RNA, 18 nt, artificial
  Chemically synthesized
aaauuuccagugucuugg

SEQ ID NO: 4158 - RNA, 18 nt, artificial
  Chemically synthesized
uugugaaaguaaacaagg

SEQ ID NO: 4159 - RNA, 18 nt, artificial
  Chemically synthesized
aaugagucaaguugcucc

SEQ ID NO: 4160 - RNA, 18 nt, artificial
  Chemically synthesized
uguuuucuacugugauuc

SEQ ID NO: 4161 - RNA, 18 nt, artificial
  Chemically synthesized
auucuuccuuggagaggc

SEQ ID NO: 4162 - RNA, 18 nt, artificial
  Chemically synthesized
uaaagaucccaacuagac

SEQ ID NO: 4163 - RNA, 18 nt, artificial
  Chemically synthesized
aauccuucccgcugagcc

SEQ ID NO: 4164 - RNA, 18 nt, artificial
  Chemically synthesized
acaucuacaaaaaucucc

SEQ ID NO: 4165 - RNA, 18 nt, artificial
  Chemically synthesized
uaggucuccuuuggaucc

SEQ ID NO: 4166 - RNA, 18 nt, artificial
  Chemically synthesized
ugucuugggaaugcagcc

SEQ ID NO: 4167 - RNA, 18 nt, artificial
  Chemically synthesized
aauacuuugccuuguugc

SEQ ID NO: 4168 - RNA, 18 nt, artificial
  Chemically synthesized
aaccuuggaauaugcagc

SEQ ID NO: 4169 - RNA, 18 nt, artificial
  Chemically synthesized
acuguaagaaacaaaugc

SEQ ID NO: 4170 - RNA, 18 nt, artificial
  Chemically synthesized
ucugguagagucaucaac

SEQ ID NO: 4171 - RNA, 18 nt, artificial
  Chemically synthesized
ugauuggaggauucuucc

SEQ ID NO: 4172 - RNA, 18 nt, artificial
  Chemically synthesized
gucucuccgguuuuuucc

SEQ ID NO: 4173 - RNA, 18 nt, artificial
  Chemically synthesized
cuagugacauaaagaucc

SEQ ID NO: 4174 - RNA, 18 nt, artificial
  Chemically synthesized
acuagacaaagacugguc

SEQ ID NO: 4175 - RNA, 18 nt, artificial
  Chemically synthesized
uucucaucaaaaagacgg

SEQ ID NO: 4176 - RNA, 18 nt, artificial
  Chemically synthesized
auagacuuaugaucaugg

SEQ ID NO: 4177 - RNA, 18 nt, artificial
  Chemically synthesized
aauggaguuuaaagaucc

SEQ ID NO: 4178 - RNA, 18 nt, artificial
  Chemically synthesized
aaacacugggagaacucc

SEQ ID NO: 4179 - RNA, 18 nt, artificial
  Chemically synthesized
uugcaacaccaaacacug

SEQ ID NO: 4180 - RNA, 18 nt, artificial
  Chemically synthesized
ccaacuagacaaagacug

SEQ ID NO: 4181 - RNA, 18 nt, artificial
  Chemically synthesized
accauaagguucuccacc

SEQ ID NO: 4182 - RNA, 18 nt, artificial
  Chemically synthesized
auccugcaaccaauuccc

SEQ ID NO: 4183 - RNA, 18 nt, artificial
  Chemically synthesized
aacacugggagaacuccg

SEQ ID NO: 4184 - RNA, 18 nt, artificial
  Chemically synthesized
auacuugcaccacucacu

SEQ ID NO: 4185 - RNA, 18 nt, artificial
  Chemically synthesized
cuucaacccacaacuacc

SEQ ID NO: 4186 - RNA, 18 nt, artificial
  Chemically synthesized
cacugacaaguuucaggc

SEQ ID NO: 4187 - RNA, 18 nt, artificial
  Chemically synthesized
aauugagauuguuguugc

SEQ ID NO: 4188 - RNA, 18 nt, artificial
  Chemically synthesized
ugauauugucaaugaucc

SEQ ID NO: 4189 - RNA, 18 nt, artificial
  Chemically synthesized
aucagaugacuuacauuc

SEQ ID NO: 4190 - RNA, 18 nt, artificial
  Chemically synthesized
uugaaguucuccagcucc

SEQ ID NO: 4191 - RNA, 18 nt, artificial
  Chemically synthesized
uaaauguucaagacugcc

SEQ ID NO: 4192 - RNA, 18 nt, artificial
  Chemically synthesized
agugagcaaagucucucc

SEQ ID NO: 4193 - RNA, 18 nt, artificial
  Chemically synthesized
uauugucaaugauccacu

SEQ ID NO: 4194 - RNA, 18 nt, artificial
  Chemically synthesized
ucaaaugacgguacaucc

SEQ ID NO: 4195 - RNA, 18 nt, artificial
  Chemically synthesized
uuaccaacuccauuaagg

SEQ ID NO: 4196 - RNA, 18 nt, artificial
  Chemically synthesized
augccaaaugauuuugcc

SEQ ID NO: 4197 - RNA, 18 nt, artificial
  Chemically synthesized
agaaugacacagucauug

SEQ ID NO: 4198 - RNA, 18 nt, artificial
  Chemically synthesized
ucccaacuagacaaagac

SEQ ID NO: 4199 - RNA, 18 nt, artificial
  Chemically synthesized
uuuuuucucaaugggcuc

SEQ ID NO: 4200 - RNA, 18 nt, artificial
  Chemically synthesized
guuuuguaaggauuuccc

SEQ ID NO: 4201 - RNA, 18 nt, artificial
  Chemically synthesized
aaucaaucaagacuuugg

SEQ ID NO: 4202 - RNA, 18 nt, artificial
  Chemically synthesized
cugauuggaggauucuuc

SEQ ID NO: 4203 - RNA, 18 nt, artificial
  Chemically synthesized
uuugaaucuuagugaagg

SEQ ID NO: 4204 - RNA, 18 nt, artificial
  Chemically synthesized
agacuggucuuaaauaug

SEQ ID NO: 4205 - RNA, 18 nt, artificial
  Chemically synthesized
uggaccauaagguucucc

SEQ ID NO: 4206 - RNA, 18 nt, artificial
  Chemically synthesized
uccaaaucaguaucucgc

SEQ ID NO: 4207 - RNA, 18 nt, artificial
  Chemically synthesized
auuccgacaccgagaggc

SEQ ID NO: 4208 - RNA, 18 nt, artificial
  Chemically synthesized
ugaagucaaccaacugug

SEQ ID NO: 4209 - RNA, 18 nt, artificial
  Chemically synthesized
agugaaagagcaaugggc

SEQ ID NO: 4210 - RNA, 18 nt, artificial
  Chemically synthesized
uuuucacugagauccaag

SEQ ID NO: 4211 - RNA, 18 nt, artificial
  Chemically synthesized
agagaaugccuuuugugg

SEQ ID NO: 4212 - RNA, 18 nt, artificial
  Chemically synthesized
ugaaaguaaacaaggaac

SEQ ID NO: 4213 - RNA, 18 nt, artificial
  Chemically synthesized
uuuucagaaagcacaaag

SEQ ID NO: 4214 - RNA, 18 nt, artificial
  Chemically synthesized
agaauggcagcaucauug

SEQ ID NO: 4215 - RNA, 18 nt, artificial
  Chemically synthesized
uagguaggacagagaaug

SEQ ID NO: 4216 - RNA, 18 nt, artificial
  Chemically synthesized
uucauacuugcaccacuc

SEQ ID NO: 4217 - RNA, 18 nt, artificial
  Chemically synthesized
ucaguaucucgcaguucc

SEQ ID NO: 4218 - RNA, 18 nt, artificial
  Chemically synthesized
ucuaaauguucaagacug

SEQ ID NO: 4219 - RNA, 18 nt, artificial
  Chemically synthesized
cagcucucagauuuaccc

SEQ ID NO: 4220 - RNA, 18 nt, artificial
  Chemically synthesized
cucaaggaagguaagucc

SEQ ID NO: 4221 - RNA, 18 nt, artificial
  Chemically synthesized
auagcaacaaguuuuggg

SEQ ID NO: 4222 - RNA, 18 nt, artificial
  Chemically synthesized
guuuuaguaagcaagucc

SEQ ID NO: 4223 - RNA, 18 nt, artificial
  Chemically synthesized
uaucucgcaguuccaaac

SEQ ID NO: 4224 - RNA, 18 nt, artificial
  Chemically synthesized
ucuucacaaaguuuucag

SEQ ID NO: 4225 - RNA, 18 nt, artificial
  Chemically synthesized
aaaccuuggaauaugcag

SEQ ID NO: 4226 - RNA, 18 nt, artificial
  Chemically synthesized
uguucauuaucuuccgca

SEQ ID NO: 4227 - RNA, 18 nt, artificial
  Chemically synthesized
ccauaagguucuccaccc

SEQ ID NO: 4228 - RNA, 18 nt, artificial
  Chemically synthesized
acugggagaacuccgagc

SEQ ID NO: 4229 - RNA, 18 nt, artificial
  Chemically synthesized
caaugggcacaaugagcc

SEQ ID NO: 4230 - RNA, 18 nt, artificial
  Chemically synthesized
accuuggaauaugcagcc

SEQ ID NO: 4231 - RNA, 18 nt, artificial
  Chemically synthesized
uugcagauaccauugcgg

SEQ ID NO: 4232 - RNA, 18 nt, artificial
  Chemically synthesized
agaggagucucuuagcag

SEQ ID NO: 4233 - RNA, 18 nt, artificial
  Chemically synthesized
aauccagaaaucugauuc

SEQ ID NO: 4234 - RNA, 18 nt, artificial
  Chemically synthesized
uacacagcacuuuuuucu

SEQ ID NO: 4235 - RNA, 18 nt, artificial
  Chemically synthesized
uuguguuaauuccauugg

SEQ ID NO: 4236 - RNA, 18 nt, artificial
  Chemically synthesized
aaguauucuucaaccauc

SEQ ID NO: 4237 - RNA, 18 nt, artificial
  Chemically synthesized
ucuaaaauuaccaacucc

SEQ ID NO: 4238 - RNA, 18 nt, artificial
  Chemically synthesized
ucuguaggucacuguugc

SEQ ID NO: 4239 - RNA, 18 nt, artificial
  Chemically synthesized
auauuucccacucucagg

SEQ ID NO: 4240 - RNA, 18 nt, artificial
  Chemically synthesized
agaacuccgagcagucac

SEQ ID NO: 4241 - RNA, 18 nt, artificial
  Chemically synthesized
ugaaggagaggaauucac

SEQ ID NO: 4242 - RNA, 18 nt, artificial
  Chemically synthesized
aucaaucaagacuuuggc

SEQ ID NO: 4243 - RNA, 18 nt, artificial
  Chemically synthesized
auggcagcaucauuguuc

SEQ ID NO: 4244 - RNA, 18 nt, artificial
  Chemically synthesized
cuuccaaagucuucagug

SEQ ID NO: 4245 - RNA, 18 nt, artificial
  Chemically synthesized
acuggucuuaaauauggg

SEQ ID NO: 4246 - RNA, 18 nt, artificial
  Chemically synthesized
uaaaguucuuugaguugc

SEQ ID NO: 4247 - RNA, 18 nt, artificial
  Chemically synthesized
uuguccagugcuucaacc

SEQ ID NO: 4248 - RNA, 18 nt, artificial
  Chemically synthesized
aaacuuuuuggcucauag

SEQ ID NO: 4249 - RNA, 18 nt, artificial
  Chemically synthesized
ucugaagcaucaaucuca

SEQ ID NO: 4250 - RNA, 18 nt, artificial
  Chemically synthesized
ugaaaugagucaaguugc

SEQ ID NO: 4251 - RNA, 18 nt, artificial
  Chemically synthesized
uuuuuggcucauagcucu

SEQ ID NO: 4252 - RNA, 18 nt, artificial
  Chemically synthesized
uacuuugccuuguugcuc

SEQ ID NO: 4253 - RNA, 18 nt, artificial
  Chemically synthesized
aaaugaaguuauugccac

SEQ ID NO: 4254 - RNA, 18 nt, artificial
  Chemically synthesized
gaacuccgagcagucacc

SEQ ID NO: 4255 - RNA, 18 nt, artificial
  Chemically synthesized
agaaguccaguucauacu

SEQ ID NO: 4256 - RNA, 18 nt, artificial
  Chemically synthesized
aaguauguggcauugucc

SEQ ID NO: 4257 - RNA, 18 nt, artificial
  Chemically synthesized
uauuucaucuuuucuggc

SEQ ID NO: 4258 - RNA, 18 nt, artificial
  Chemically synthesized
aaaguuuucagaaagcac

SEQ ID NO: 4259 - RNA, 18 nt, artificial
  Chemically synthesized
uacagauuacaguuggcc

SEQ ID NO: 4260 - RNA, 18 nt, artificial
  Chemically synthesized
gcaucaaucucaaguucc

SEQ ID NO: 4261 - RNA, 18 nt, artificial
  Chemically synthesized
aauaugggaaccuaggac

SEQ ID NO: 4262 - RNA, 18 nt, artificial
  Chemically synthesized
ucuacaaaaaucuccagc

SEQ ID NO: 4263 - RNA, 18 nt, artificial
  Chemically synthesized
aguucuuugaguugcggc

SEQ ID NO: 4264 - RNA, 18 nt, artificial
  Chemically synthesized
aauguucaagacugccca

SEQ ID NO: 4265 - RNA, 18 nt, artificial
  Chemically synthesized
gucaucaaacucuaauuc

SEQ ID NO: 4266 - RNA, 18 nt, artificial
  Chemically synthesized
cuuuuuucucaaugggcu

SEQ ID NO: 4267 - RNA, 18 nt, artificial
  Chemically synthesized
caacuagacaaagacugg

SEQ ID NO: 4268 - RNA, 18 nt, artificial
  Chemically synthesized
aagacacaacuugaaggg

SEQ ID NO: 4269 - RNA, 18 nt, artificial
  Chemically synthesized
uggcuuuuuucucaaugg

SEQ ID NO: 4270 - RNA, 18 nt, artificial
  Chemically synthesized
gauccugcaaccaauucc

SEQ ID NO: 4271 - RNA, 18 nt, artificial
  Chemically synthesized
aaguuuucagaaagcaca

SEQ ID NO: 4272 - RNA, 18 nt, artificial
  Chemically synthesized
gagugagcaaagucucuc

SEQ ID NO: 4273 - RNA, 18 nt, artificial
  Chemically synthesized
acuuggucacuaagagcu

SEQ ID NO: 4274 - RNA, 18 nt, artificial
  Chemically synthesized
acuccagguaggucuugg

SEQ ID NO: 4275 - RNA, 18 nt, artificial
  Chemically synthesized
uuuuuuccaaugaugcca

SEQ ID NO: 4276 - RNA, 18 nt, artificial
  Chemically synthesized
acuauaggucuccuuugg

SEQ ID NO: 4277 - RNA, 18 nt, artificial
  Chemically synthesized
guacagucaucaaacucu

SEQ ID NO: 4278 - RNA, 18 nt, artificial
  Chemically synthesized
uuuucauauaccacaggc

SEQ ID NO: 4279 - RNA, 18 nt, artificial
  Chemically synthesized
uguuaauuccauuggaug

SEQ ID NO: 4280 - RNA, 18 nt, artificial
  Chemically synthesized
ugacauaaagaucccaac

SEQ ID NO: 4281 - RNA, 18 nt, artificial
  Chemically synthesized
aaguaaacaaggaaccag

SEQ ID NO: 4282 - RNA, 18 nt, artificial
  Chemically synthesized
aaccuaggacuuuaucgc

SEQ ID NO: 4283 - RNA, 18 nt, artificial
  Chemically synthesized
auaagguucuccacccag

SEQ ID NO: 4284 - RNA, 18 nt, artificial
  Chemically synthesized
uagugacauaaagauccc

SEQ ID NO: 4285 - RNA, 18 nt, artificial
  Chemically synthesized
aaugauccacuugccagg

SEQ ID NO: 4286 - RNA, 18 nt, artificial
  Chemically synthesized
cucuauuguguuaauucc

SEQ ID NO: 4287 - RNA, 18 nt, artificial
  Chemically synthesized
cuuacauucugaauugac

SEQ ID NO: 4288 - RNA, 18 nt, artificial
  Chemically synthesized
auggcuuuuuucucaaug

SEQ ID NO: 4289 - RNA, 18 nt, artificial
  Chemically synthesized
augcagccuguuacacug

SEQ ID NO: 4290 - RNA, 18 nt, artificial
  Chemically synthesized
caucauagcagauguucc

SEQ ID NO: 4291 - RNA, 18 nt, artificial
  Chemically synthesized
ucuccuuuggauccugcu

SEQ ID NO: 4292 - RNA, 18 nt, artificial
  Chemically synthesized
gagucacuauaggucucc

SEQ ID NO: 4293 - RNA, 18 nt, artificial
  Chemically synthesized
gagccuggagguucacac

SEQ ID NO: 4294 - RNA, 18 nt, artificial
  Chemically synthesized
uauauccauggguucugc

SEQ ID NO: 4295 - RNA, 18 nt, artificial
  Chemically synthesized
uauaggucuccuuuggau

SEQ ID NO: 4296 - RNA, 18 nt, artificial
  Chemically synthesized
cuuuuuggcucauagcuc

SEQ ID NO: 4297 - RNA, 18 nt, artificial
  Chemically synthesized
gugucuugggaaugcagc

SEQ ID NO: 4298 - RNA, 18 nt, artificial
  Chemically synthesized
ucuuaaguucauuugugc

SEQ ID NO: 4299 - RNA, 18 nt, artificial
  Chemically synthesized
auguuaaagaagaaaggg

SEQ ID NO: 4300 - RNA, 18 nt, artificial
  Chemically synthesized
uaccaagggacuauauuc

SEQ ID NO: 4301 - RNA, 18 nt, artificial
  Chemically synthesized
cuagacaaagacuggucu

SEQ ID NO: 4302 - RNA, 18 nt, artificial
  Chemically synthesized
gugcuucaacccacaacu

SEQ ID NO: 4303 - RNA, 18 nt, artificial
  Chemically synthesized
gcaaaugaaguuauugcc

SEQ ID NO: 4304 - RNA, 18 nt, artificial
  Chemically synthesized
uuggaggauucuuccuug

SEQ ID NO: 4305 - RNA, 18 nt, artificial
  Chemically synthesized
acaaagacaguuuugugg

SEQ ID NO: 4306 - RNA, 18 nt, artificial
  Chemically synthesized
aaugaaguuauugccacc

SEQ ID NO: 4307 - RNA, 18 nt, artificial
  Chemically synthesized
uaguuauugcauuccuac

SEQ ID NO: 4308 - RNA, 18 nt, artificial
  Chemically synthesized
ucacaagacagagaagcc

SEQ ID NO: 4309 - RNA, 18 nt, artificial
  Chemically synthesized
uugaaagcagugaaagag

SEQ ID NO: 4310 - RNA, 18 nt, artificial
  Chemically synthesized
aaaugagucaaguugcuc

SEQ ID NO: 4311 - RNA, 18 nt, artificial
  Chemically synthesized
uccuuuggauccugcuug

SEQ ID NO: 4312 - RNA, 18 nt, artificial
  Chemically synthesized
cucuaauucuaacaaucc

SEQ ID NO: 4313 - RNA, 18 nt, artificial
  Chemically synthesized
auaugggaaccuaggacu

SEQ ID NO: 4314 - RNA, 18 nt, artificial
  Chemically synthesized
agcaaaugaaguuauugc

SEQ ID NO: 4315 - RNA, 18 nt, artificial
  Chemically synthesized
aaacgguggcacaggacc

SEQ ID NO: 4316 - RNA, 18 nt, artificial
  Chemically synthesized
ugaauuuugauauccacg

SEQ ID NO: 4317 - RNA, 18 nt, artificial
  Chemically synthesized
ugagcaaagucucuccgg

SEQ ID NO: 4318 - RNA, 18 nt, artificial
  Chemically synthesized
aaugcagccuguuacacu

SEQ ID NO: 4319 - RNA, 18 nt, artificial
  Chemically synthesized
uuauugccaccagcuucc

SEQ ID NO: 4320 - RNA, 18 nt, artificial
  Chemically synthesized
uacuugcaccacucacuc

SEQ ID NO: 4321 - RNA, 18 nt, artificial
  Chemically synthesized
uucagugugugaaaugag

SEQ ID NO: 4322 - RNA, 18 nt, artificial
  Chemically synthesized
agagaagccugauuggag

SEQ ID NO: 4323 - RNA, 18 nt, artificial
  Chemically synthesized
aagguguccauauuuccc

SEQ ID NO: 4324 - RNA, 18 nt, artificial
  Chemically synthesized
ucacuaagagcuccuggg

SEQ ID NO: 4325 - RNA, 18 nt, artificial
  Chemically synthesized
uuggucacuaagagcucc

SEQ ID NO: 4326 - RNA, 18 nt, artificial
  Chemically synthesized
ucuugggaaugcagccug

SEQ ID NO: 4327 - RNA, 18 nt, artificial
  Chemically synthesized
aaucuuagugaagguguc

SEQ ID NO: 4328 - RNA, 18 nt, artificial
  Chemically synthesized
uuggaauaugcagccucc

SEQ ID NO: 4329 - RNA, 18 nt, artificial
  Chemically synthesized
uccauuaaggguacaguc

SEQ ID NO: 4330 - RNA, 18 nt, artificial
  Chemically synthesized
ucuugguguucauuaucu

SEQ ID NO: 4331 - RNA, 18 nt, artificial
  Chemically synthesized
cugauaucaauguuaguc

SEQ ID NO: 4332 - RNA, 18 nt, artificial
  Chemically synthesized
gauuugcaauuuugugag

SEQ ID NO: 4333 - RNA, 18 nt, artificial
  Chemically synthesized
guaaguccagcaaaaucu

SEQ ID NO: 4334 - RNA, 18 nt, artificial
  Chemically synthesized
aucuuagugaaggugucc

SEQ ID NO: 4335 - RNA, 18 nt, artificial
  Chemically synthesized
acaaaugcaucauagcag

SEQ ID NO: 4336 - RNA, 18 nt, artificial
  Chemically synthesized
uaaaaccuuggaauaugc

SEQ ID NO: 4337 - RNA, 18 nt, artificial
  Chemically synthesized
gguuuuguaaggauuucc

SEQ ID NO: 4338 - RNA, 18 nt, artificial
  Chemically synthesized
aguccaguucauacuugc

SEQ ID NO: 4339 - RNA, 18 nt, artificial
  Chemically synthesized
agucuaaauguucaagac

SEQ ID NO: 4340 - RNA, 18 nt, artificial
  Chemically synthesized
uuuccuaaugaacuaagc

SEQ ID NO: 4341 - RNA, 18 nt, artificial
  Chemically synthesized
cacagaggagucucuuag

SEQ ID NO: 4342 - RNA, 18 nt, artificial
  Chemically synthesized
gagaaugccuuuuguggc

SEQ ID NO: 4343 - RNA, 18 nt, artificial
  Chemically synthesized
gaagaaaaagaaucuucc

SEQ ID NO: 4344 - RNA, 18 nt, artificial
  Chemically synthesized
uucuccagcuccuggacc

SEQ ID NO: 4345 - RNA, 18 nt, artificial
  Chemically synthesized
acucugucauuaucagau

SEQ ID NO: 4346 - RNA, 18 nt, artificial
  Chemically synthesized
auugaaguucuccagcuc

SEQ ID NO: 4347 - RNA, 18 nt, artificial
  Chemically synthesized
agaggaauucacaggagc

SEQ ID NO: 4348 - RNA, 18 nt, artificial
  Chemically synthesized
aggcggacauccugaacc

SEQ ID NO: 4349 - RNA, 18 nt, artificial
  Chemically synthesized
gugagcaaagucucuccg

SEQ ID NO: 4350 - RNA, 18 nt, artificial
  Chemically synthesized
cuuuuuacagcuucugug

SEQ ID NO: 4351 - RNA, 18 nt, artificial
  Chemically synthesized
ccacugacaaguuucagg

SEQ ID NO: 4352 - RNA, 18 nt, artificial
  Chemically synthesized
gucacaagacagagaagc

SEQ ID NO: 4353 - RNA, 18 nt, artificial
  Chemically synthesized
uaggaaauacacagcacu

SEQ ID NO: 4354 - RNA, 18 nt, artificial
  Chemically synthesized
aggagaggaauucacagg

SEQ ID NO: 4355 - RNA, 18 nt, artificial
  Chemically synthesized
guuauugcauuccuacug

SEQ ID NO: 4356 - RNA, 18 nt, artificial
  Chemically synthesized
aagacaguuuuguggcuc

SEQ ID NO: 4357 - RNA, 18 nt, artificial
  Chemically synthesized
gguucuccacccaguagg

SEQ ID NO: 4358 - RNA, 18 nt, artificial
  Chemically synthesized
aucucaaguuccucaagg

SEQ ID NO: 4359 - RNA, 18 nt, artificial
  Chemically synthesized
uuugcuggccaaucaauc

SEQ ID NO: 4360 - RNA, 18 nt, artificial
  Chemically synthesized
ucacuguugcuaauguag

SEQ ID NO: 4361 - RNA, 18 nt, artificial
  Chemically synthesized
aaaugacgguacauccac

SEQ ID NO: 4362 - RNA, 18 nt, artificial
  Chemically synthesized
aaacaaaugcaucauagc

SEQ ID NO: 4363 - RNA, 18 nt, artificial
  Chemically synthesized
uccaguucauacuugcac

SEQ ID NO: 4364 - RNA, 18 nt, artificial
  Chemically synthesized
aggguacagucaucaaac

SEQ ID NO: 4365 - RNA, 18 nt, artificial
  Chemically synthesized
cuguuacacuguguauuc

SEQ ID NO: 4366 - RNA, 18 nt, artificial
  Chemically synthesized
agucucuccgguuuuuuc

SEQ ID NO: 4367 - RNA, 18 nt, artificial
  Chemically synthesized
uuuuaguaagcaaguccu

SEQ ID NO: 4368 - RNA, 18 nt, artificial
  Chemically synthesized
ucuccagcaguaaaauau

SEQ ID NO: 4369 - RNA, 18 nt, artificial
  Chemically synthesized
auauugucaaugauccac

SEQ ID NO: 4370 - RNA, 18 nt, artificial
  Chemically synthesized
ucaucaacuuauuucugg

SEQ ID NO: 4371 - RNA, 18 nt, artificial
  Chemically synthesized
acuagugacauaaagauc

SEQ ID NO: 4372 - RNA, 18 nt, artificial
  Chemically synthesized
auuggaggauucuuccuu

SEQ ID NO: 4373 - RNA, 18 nt, artificial
  Chemically synthesized
gucuccuuuggauccugc

SEQ ID NO: 4374 - RNA, 18 nt, artificial
  Chemically synthesized
uugguguucauuaucuuc

SEQ ID NO: 4375 - RNA, 18 nt, artificial
  Chemically synthesized
ugaauauaaagugcucag

SEQ ID NO: 4376 - RNA, 18 nt, artificial
  Chemically synthesized
auacuuugccuuguugcu

SEQ ID NO: 4377 - RNA, 18 nt, artificial
  Chemically synthesized
aaaucaguaucucgcagu

SEQ ID NO: 4378 - RNA, 18 nt, artificial
  Chemically synthesized
gauugaaguucuccagcu

SEQ ID NO: 4379 - RNA, 18 nt, artificial
  Chemically synthesized
gacuggucuuaaauaugg

SEQ ID NO: 4380 - RNA, 18 nt, artificial
  Chemically synthesized
uuaugaagacacaacuug

SEQ ID NO: 4381 - RNA, 18 nt, artificial
  Chemically synthesized
aaggagaggaauucacag

SEQ ID NO: 4382 - RNA, 18 nt, artificial
  Chemically synthesized
cuugcaacaccaaacacu

SEQ ID NO: 4383 - RNA, 18 nt, artificial
  Chemically synthesized
auauaaagugcucagauc

SEQ ID NO: 4384 - RNA, 18 nt, artificial
  Chemically synthesized
guaccuucacuuggucac

SEQ ID NO: 4385 - RNA, 18 nt, artificial
  Chemically synthesized
uucugugagcccugaggg

SEQ ID NO: 4386 - RNA, 18 nt, artificial
  Chemically synthesized
caaacacugggagaacuc

SEQ ID NO: 4387 - RNA, 18 nt, artificial
  Chemically synthesized
gggauugaaguucuccag

SEQ ID NO: 4388 - RNA, 18 nt, artificial
  Chemically synthesized
aucaugguuaucucauag

SEQ ID NO: 4389 - RNA, 18 nt, artificial
  Chemically synthesized
caacuaccaguugaaagc

SEQ ID NO: 4390 - RNA, 18 nt, artificial
  Chemically synthesized
cugcuugcaacaccaaac

SEQ ID NO: 4391 - RNA, 18 nt, artificial
  Chemically synthesized
auccacaaaguauguggc

SEQ ID NO: 4392 - RNA, 18 nt, artificial
  Chemically synthesized
cuucaaacuuuuuggcuc

SEQ ID NO: 4393 - RNA, 18 nt, artificial
  Chemically synthesized
cauccacaaaguaugugg

SEQ ID NO: 4394 - RNA, 18 nt, artificial
  Chemically synthesized
accaucaaauuuucacug

SEQ ID NO: 4395 - RNA, 18 nt, artificial
  Chemically synthesized
acacagguaauuugcugg

SEQ ID NO: 4396 - RNA, 18 nt, artificial
  Chemically synthesized
caggcugaauuuuucaag

SEQ ID NO: 4397 - RNA, 18 nt, artificial
  Chemically synthesized
aggauuugcaauuuugug

SEQ ID NO: 4398 - RNA, 18 nt, artificial
  Chemically synthesized
auugcggucacaagacag

SEQ ID NO: 4399 - RNA, 18 nt, artificial
  Chemically synthesized
caucugguagagucauca

SEQ ID NO: 4400 - RNA, 18 nt, artificial
  Chemically synthesized
augaacuaagccaguugc

SEQ ID NO: 4401 - RNA, 18 nt, artificial
  Chemically synthesized
agaaugccuuuuguggcc

SEQ ID NO: 4402 - RNA, 18 nt, artificial
  Chemically synthesized
uauccacgaggauccugc

SEQ ID NO: 4403 - RNA, 18 nt, artificial
  Chemically synthesized
cucaaaugacgguacauc

SEQ ID NO: 4404 - RNA, 18 nt, artificial
  Chemically synthesized
acacugggagaacuccga

SEQ ID NO: 4405 - RNA, 18 nt, artificial
  Chemically synthesized
uuuuguaaggauuuccca

SEQ ID NO: 4406 - RNA, 18 nt, artificial
  Chemically synthesized
auggguucugcauccaug

SEQ ID NO: 4407 - RNA, 18 nt, artificial
  Chemically synthesized
cagcuuccaaagucuuca

SEQ ID NO: 4408 - RNA, 18 nt, artificial
  Chemically synthesized
uccauggguucugcaucc

SEQ ID NO: 4409 - RNA, 18 nt, artificial
  Chemically synthesized
acacagucauugagaauc

SEQ ID NO: 4410 - RNA, 18 nt, artificial
  Chemically synthesized
acuucaaacuuuuuggcu

SEQ ID NO: 4411 - RNA, 18 nt, artificial
  Chemically synthesized
aucugaagcaucaaucuc

SEQ ID NO: 4412 - RNA, 18 nt, artificial
  Chemically synthesized
agaugcucuaaaauuacc

SEQ ID NO: 4413 - RNA, 18 nt, artificial
  Chemically synthesized
uuuacccaaaauccuucc

SEQ ID NO: 4414 - RNA, 18 nt, artificial
  Chemically synthesized
ucugucauuaucagaugc

SEQ ID NO: 4415 - RNA, 18 nt, artificial
  Chemically synthesized
auuguuguugcuaacauc

SEQ ID NO: 4416 - RNA, 18 nt, artificial
  Chemically synthesized
augggagaaguccaguuc

SEQ ID NO: 4417 - RNA, 18 nt, artificial
  Chemically synthesized
cuggcugcgcuuucucgc

SEQ ID NO: 4418 - RNA, 18 nt, artificial
  Chemically synthesized
ucuucagugugugaaaug

SEQ ID NO: 4419 - RNA, 18 nt, artificial
  Chemically synthesized
uguucaagacugcccagg

SEQ ID NO: 4420 - RNA, 18 nt, artificial
  Chemically synthesized
uucauuaucuuccgcagc

SEQ ID NO: 4421 - RNA, 18 nt, artificial
  Chemically synthesized
acuuuuuggcucauagcu

SEQ ID NO: 4422 - RNA, 18 nt, artificial
  Chemically synthesized
gacagagaagccugauug

SEQ ID NO: 4423 - RNA, 18 nt, artificial
  Chemically synthesized
uaagguucuccacccagu

SEQ ID NO: 4424 - RNA, 18 nt, artificial
  Chemically synthesized
uuucaucggugauuuuca

SEQ ID NO: 4425 - RNA, 18 nt, artificial
  Chemically synthesized
uaacucugucauuaucag

SEQ ID NO: 4426 - RNA, 18 nt, artificial
  Chemically synthesized
uguccaaaucaguaucuc

SEQ ID NO: 4427 - RNA, 18 nt, artificial
  Chemically synthesized
cacuugccaggaaugaag

SEQ ID NO: 4428 - RNA, 18 nt, artificial
  Chemically synthesized
aauuuccagugucuuggg

SEQ ID NO: 4429 - RNA, 18 nt, artificial
  Chemically synthesized
gauccugcuugcaacacc

SEQ ID NO: 4430 - RNA, 18 nt, artificial
  Chemically synthesized
gcuuuuuucucaaugggc

SEQ ID NO: 4431 - RNA, 18 nt, artificial
  Chemically synthesized
auuccauuggaugucagc

SEQ ID NO: 4432 - RNA, 18 nt, artificial
  Chemically synthesized
caaagucuucagugugug

SEQ ID NO: 4433 - RNA, 18 nt, artificial
  Chemically synthesized
gccacuccagguaggucu

SEQ ID NO: 4434 - RNA, 18 nt, artificial
  Chemically synthesized
caaagacaguuuuguggc

SEQ ID NO: 4435 - RNA, 18 nt, artificial
  Chemically synthesized
agagaacgccgagcagcc

SEQ ID NO: 4436 - RNA, 18 nt, artificial
  Chemically synthesized
acagguaccuucacuugg

SEQ ID NO: 4437 - RNA, 18 nt, artificial
  Chemically synthesized
aaugcaucauagcagaug

SEQ ID NO: 4438 - RNA, 18 nt, artificial
  Chemically synthesized
aagcaucaaucucaaguu

SEQ ID NO: 4439 - RNA, 18 nt, artificial
  Chemically synthesized
uucauuugugcuguuucc

SEQ ID NO: 4440 - RNA, 18 nt, artificial
  Chemically synthesized
ucaggauuugcaauuuug

SEQ ID NO: 4441 - RNA, 18 nt, artificial
  Chemically synthesized
aggaagaaagaaugacac

SEQ ID NO: 4442 - RNA, 18 nt, artificial
  Chemically synthesized
aaaaaagagauguuuccc

SEQ ID NO: 4443 - RNA, 18 nt, artificial
  Chemically synthesized
uaugaaggaucagaugac

SEQ ID NO: 4444 - RNA, 18 nt, artificial
  Chemically synthesized
uuaauuccauuggauguc

SEQ ID NO: 4445 - RNA, 18 nt, artificial
  Chemically synthesized
acguuuccacuuuaccug

SEQ ID NO: 4446 - RNA, 18 nt, artificial
  Chemically synthesized
uugagaucagcugcacag

SEQ ID NO: 4447 - RNA, 18 nt, artificial
  Chemically synthesized
uguuuauaaaacagcacc

SEQ ID NO: 4448 - RNA, 18 nt, artificial
  Chemically synthesized
uauaaagugcucagauca

SEQ ID NO: 4449 - RNA, 18 nt, artificial
  Chemically synthesized
uuccuuuuggccuggagc

SEQ ID NO: 4450 - RNA, 18 nt, artificial
  Chemically synthesized
aauaugcugcuucauaug

SEQ ID NO: 4451 - RNA, 18 nt, artificial
  Chemically synthesized
ucuuuucuggccacugac

SEQ ID NO: 4452 - RNA, 18 nt, artificial
  Chemically synthesized
uccauauuucccacucuc

SEQ ID NO: 4453 - RNA, 18 nt, artificial
  Chemically synthesized
uccagaagaaugagaaug

SEQ ID NO: 4454 - RNA, 18 nt, artificial
  Chemically synthesized
agaaagaaugacacaguc

SEQ ID NO: 4455 - RNA, 18 nt, artificial
  Chemically synthesized
cagacaccagugcugucc

SEQ ID NO: 4456 - RNA, 18 nt, artificial
  Chemically synthesized
acguaguuauugcauucc

SEQ ID NO: 4457 - RNA, 18 nt, artificial
  Chemically synthesized
aucaaucucaaguuccuc

SEQ ID NO: 4458 - RNA, 18 nt, artificial
  Chemically synthesized
uccagugcuucaacccac

SEQ ID NO: 4459 - RNA, 18 nt, artificial
  Chemically synthesized
uaagagggaggcaucugg

SEQ ID NO: 4460 - RNA, 18 nt, artificial
  Chemically synthesized
acaacuaccaguugaaag

SEQ ID NO: 4461 - RNA, 18 nt, artificial
  Chemically synthesized
ugucauuaucagaugcuc

SEQ ID NO: 4462 - RNA, 18 nt, artificial
  Chemically synthesized
cuuggaauaugcagccuc

SEQ ID NO: 4463 - RNA, 18 nt, artificial
  Chemically synthesized
uuuucaauggagucaaug

SEQ ID NO: 4464 - RNA, 18 nt, artificial
  Chemically synthesized
aagaucccaacuagacaa

SEQ ID NO: 4465 - RNA, 18 nt, artificial
  Chemically synthesized
aacauuccacggaacuug

SEQ ID NO: 4466 - RNA, 18 nt, artificial
  Chemically synthesized
ucucuccgguuuuuucca

SEQ ID NO: 4467 - RNA, 18 nt, artificial
  Chemically synthesized
uauuucccacucucagga

SEQ ID NO: 4468 - RNA, 18 nt, artificial
  Chemically synthesized
gaccauaagguucuccac

SEQ ID NO: 4469 - RNA, 18 nt, artificial
  Chemically synthesized
gguaggacagagaaugcc

SEQ ID NO: 4470 - RNA, 18 nt, artificial
  Chemically synthesized
cagagaaugccuuuugug

SEQ ID NO: 4471 - RNA, 18 nt, artificial
  Chemically synthesized
ucuuagugaaggugucca

SEQ ID NO: 4472 - RNA, 18 nt, artificial
  Chemically synthesized
uuaaauaugggaaccuag

SEQ ID NO: 4473 - RNA, 18 nt, artificial
  Chemically synthesized
ugaaacaaacuuucaucg

SEQ ID NO: 4474 - RNA, 18 nt, artificial
  Chemically synthesized
ugcuucauaugaaggauc

SEQ ID NO: 4475 - RNA, 18 nt, artificial
  Chemically synthesized
uaccuucacuuggucacu

SEQ ID NO: 4476 - RNA, 18 nt, artificial
  Chemically synthesized
ucaaucucaaguuccuca

SEQ ID NO: 4477 - RNA, 18 nt, artificial
  Chemically synthesized
auuaucuuccgcagcuug

SEQ ID NO: 4478 - RNA, 18 nt, artificial
  Chemically synthesized
uaagcaaguccucaaaug

SEQ ID NO: 4479 - RNA, 18 nt, artificial
  Chemically synthesized
uugcuacagauuacaguu

SEQ ID NO: 4480 - RNA, 18 nt, artificial
  Chemically synthesized
uaacaauccagaaaucug

SEQ ID NO: 4481 - RNA, 18 nt, artificial
  Chemically synthesized
aaugacacagucauugag

SEQ ID NO: 4482 - RNA, 18 nt, artificial
  Chemically synthesized
ucacuauaggucuccuuu

SEQ ID NO: 4483 - RNA, 18 nt, artificial
  Chemically synthesized
guuuuuuccaaugaugcc

SEQ ID NO: 4484 - RNA, 18 nt, artificial
  Chemically synthesized
caccauccacaaaguaug

SEQ ID NO: 4485 - RNA, 18 nt, artificial
  Chemically synthesized
acuccauuaaggguacag

SEQ ID NO: 4486 - RNA, 18 nt, artificial
  Chemically synthesized
uaggcaucccgcucacug

SEQ ID NO: 4487 - RNA, 18 nt, artificial
  Chemically synthesized
uucccuuggauaccaagg

SEQ ID NO: 4488 - RNA, 18 nt, artificial
  Chemically synthesized
uagacaaagacuggucuu

SEQ ID NO: 4489 - RNA, 18 nt, artificial
  Chemically synthesized
gaaacaaaugcaucauag

SEQ ID NO: 4490 - RNA, 18 nt, artificial
  Chemically synthesized
acaagacagagaagccug

SEQ ID NO: 4491 - RNA, 18 nt, artificial
  Chemically synthesized
aaguuauugccaccagcu

SEQ ID NO: 4492 - RNA, 18 nt, artificial
  Chemically synthesized
uuuguagagagggccagg

SEQ ID NO: 4493 - RNA, 18 nt, artificial
  Chemically synthesized
caucuacaaaaaucucca

SEQ ID NO: 4494 - RNA, 18 nt, artificial
  Chemically synthesized
aaucuuccucuauugugu

SEQ ID NO: 4495 - RNA, 18 nt, artificial
  Chemically synthesized
ugagauccaaguauucua

SEQ ID NO: 4496 - RNA, 18 nt, artificial
  Chemically synthesized
acagaggagucucuuagc

SEQ ID NO: 4497 - RNA, 18 nt, artificial
  Chemically synthesized
ucgcaguuccaaacauuc

SEQ ID NO: 4498 - RNA, 18 nt, artificial
  Chemically synthesized
ucuuaaauaugggaaccu

SEQ ID NO: 4499 - RNA, 18 nt, artificial
  Chemically synthesized
acagcacuuuuuucuagg

SEQ ID NO: 4500 - RNA, 18 nt, artificial
  Chemically synthesized
ggauaagucuaaauguuc

SEQ ID NO: 4501 - RNA, 18 nt, artificial
  Chemically synthesized
ucaaaaagacggaaaugg

SEQ ID NO: 4502 - RNA, 18 nt, artificial
  Chemically synthesized
gggaauggcuuuuuucuc

SEQ ID NO: 4503 - RNA, 18 nt, artificial
  Chemically synthesized
caaagacuggucuuaaau

SEQ ID NO: 4504 - RNA, 18 nt, artificial
  Chemically synthesized
gucuuaaauaugggaacc

SEQ ID NO: 4505 - RNA, 18 nt, artificial
  Chemically synthesized
aguuggcccucuauaucc

SEQ ID NO: 4506 - RNA, 18 nt, artificial
  Chemically synthesized
gaagaaagaaugacacag

SEQ ID NO: 4507 - RNA, 18 nt, artificial
  Chemically synthesized
gcagcucucagauuuacc

SEQ ID NO: 4508 - RNA, 18 nt, artificial
  Chemically synthesized
uagacuuaugaucauggu

SEQ ID NO: 4509 - RNA, 18 nt, artificial
  Chemically synthesized
cugugacauuccgacacc

SEQ ID NO: 4510 - RNA, 18 nt, artificial
  Chemically synthesized
guucuccacccaguaggc

SEQ ID NO: 4511 - RNA, 18 nt, artificial
  Chemically synthesized
aaggaagguaaguccagc

SEQ ID NO: 4512 - RNA, 18 nt, artificial
  Chemically synthesized
aacuuuuuggcucauagc

SEQ ID NO: 4513 - RNA, 18 nt, artificial
  Chemically synthesized
ucauagcucuguagaucu

SEQ ID NO: 4514 - RNA, 18 nt, artificial
  Chemically synthesized
agagugagcaaagucucu

SEQ ID NO: 4515 - RNA, 18 nt, artificial
  Chemically synthesized
auacuaguaacaugggua

SEQ ID NO: 4516 - RNA, 18 nt, artificial
  Chemically synthesized
uuguuguugcuaacaucu

SEQ ID NO: 4517 - RNA, 18 nt, artificial
  Chemically synthesized
gagucaucaacuuauuuc

SEQ ID NO: 4518 - RNA, 18 nt, artificial
  Chemically synthesized
cucauagcucuguagauc

SEQ ID NO: 4519 - RNA, 18 nt, artificial
  Chemically synthesized
aaagaaugacacagucau

SEQ ID NO: 4520 - RNA, 18 nt, artificial
  Chemically synthesized
ugcucuaaaauuaccaac

SEQ ID NO: 4521 - RNA, 18 nt, artificial
  Chemically synthesized
gauccaaguauucuaaug

SEQ ID NO: 4522 - RNA, 18 nt, artificial
  Chemically synthesized
uuuccugggcuuccuuuu

SEQ ID NO: 4523 - RNA, 18 nt, artificial
  Chemically synthesized
ucccgcuuaugaagacac

SEQ ID NO: 4524 - RNA, 18 nt, artificial
  Chemically synthesized
augucagcaccagagccu

SEQ ID NO: 4525 - RNA, 18 nt, artificial
  Chemically synthesized
cauauuucccacucucag

SEQ ID NO: 4526 - RNA, 18 nt, artificial
  Chemically synthesized
gauaguucugaaaaaugg

SEQ ID NO: 4527 - RNA, 18 nt, artificial
  Chemically synthesized
aaaguauguggcauuguc

SEQ ID NO: 4528 - RNA, 18 nt, artificial
  Chemically synthesized
ucacaggcugaauuuuuc

SEQ ID NO: 4529 - RNA, 18 nt, artificial
  Chemically synthesized
agcaguaaaauaugcugc

SEQ ID NO: 4530 - RNA, 18 nt, artificial
  Chemically synthesized
ucaaucaagacuuuggcc

SEQ ID NO: 4531 - RNA, 18 nt, artificial
  Chemically synthesized
uaugcagccuccggauug

SEQ ID NO: 4532 - RNA, 18 nt, artificial
  Chemically synthesized
gguacagucaucaaacuc

SEQ ID NO: 4533 - RNA, 18 nt, artificial
  Chemically synthesized
gacagagaaugccuuuug

SEQ ID NO: 4534 - RNA, 18 nt, artificial
  Chemically synthesized
ucaccugagagaacgccg

SEQ ID NO: 4535 - RNA, 18 nt, artificial
  Chemically synthesized
aguuuuguggcucuuuuc

SEQ ID NO: 4536 - RNA, 18 nt, artificial
  Chemically synthesized
guaggacagagaaugccu

SEQ ID NO: 4537 - RNA, 18 nt, artificial
  Chemically synthesized
gucacacagguaauuugc

SEQ ID NO: 4538 - RNA, 18 nt, artificial
  Chemically synthesized
aaguucuuugaguugcgg

SEQ ID NO: 4539 - RNA, 18 nt, artificial
  Chemically synthesized
guuauugccaccagcuuc

SEQ ID NO: 4540 - RNA, 18 nt, artificial
  Chemically synthesized
aguuccaaacauuccacg

SEQ ID NO: 4541 - RNA, 18 nt, artificial
  Chemically synthesized
gagaggcugaugaugacc

SEQ ID NO: 4542 - RNA, 18 nt, artificial
  Chemically synthesized
uggcugcgcuuucucgcu

SEQ ID NO: 4543 - RNA, 18 nt, artificial
  Chemically synthesized
aagggacuauauucagau

SEQ ID NO: 4544 - RNA, 18 nt, artificial
  Chemically synthesized
aguauucuucaaccauca

SEQ ID NO: 4545 - RNA, 18 nt, artificial
  Chemically synthesized
guugcuacagauuacagu

SEQ ID NO: 4546 - RNA, 18 nt, artificial
  Chemically synthesized
auuuugauauccacgagg

SEQ ID NO: 4547 - RNA, 18 nt, artificial
  Chemically synthesized
gaagugacagcuagguag

SEQ ID NO: 4548 - RNA, 18 nt, artificial
  Chemically synthesized
aguaaacaaggaaccaga

SEQ ID NO: 4549 - RNA, 18 nt, artificial
  Chemically synthesized
aaguucuccagcuccugg

SEQ ID NO: 4550 - RNA, 18 nt, artificial
  Chemically synthesized
aaugacgguacauccacg

SEQ ID NO: 4551 - RNA, 18 nt, artificial
  Chemically synthesized
auuguuaacguuuccacu

SEQ ID NO: 4552 - RNA, 18 nt, artificial
  Chemically synthesized
aagucucuccgguuuuuu

SEQ ID NO: 4553 - RNA, 18 nt, artificial
  Chemically synthesized
agugcuucaacccacaac

SEQ ID NO: 4554 - RNA, 18 nt, artificial
  Chemically synthesized
ccaagacccacaccaucc

SEQ ID NO: 4555 - RNA, 18 nt, artificial
  Chemically synthesized
auggagucaaugauauug

SEQ ID NO: 4556 - RNA, 18 nt, artificial
  Chemically synthesized
gaaccuaggacuuuaucg

SEQ ID NO: 4557 - RNA, 18 nt, artificial
  Chemically synthesized
ugggagucacuauagguc

SEQ ID NO: 4558 - RNA, 18 nt, artificial
  Chemically synthesized
ggauugaaguucuccagc

SEQ ID NO: 4559 - RNA, 18 nt, artificial
  Chemically synthesized
aaauacuuugccuuguug

SEQ ID NO: 4560 - RNA, 18 nt, artificial
  Chemically synthesized
augccagacaccagugcu

SEQ ID NO: 4561 - RNA, 18 nt, artificial
  Chemically synthesized
aguaaaauaugcugcuuc

SEQ ID NO: 4562 - RNA, 18 nt, artificial
  Chemically synthesized
guugcggcaaauucaaag

SEQ ID NO: 4563 - RNA, 18 nt, artificial
  Chemically synthesized
agugaaggagaggaauuc

SEQ ID NO: 4564 - RNA, 18 nt, artificial
  Chemically synthesized
uuaaaguuuguagagagg

SEQ ID NO: 4565 - RNA, 18 nt, artificial
  Chemically synthesized
aacuaagccaguugcuac

SEQ ID NO: 4566 - RNA, 18 nt, artificial
  Chemically synthesized
aaaagacggaaaugggag

SEQ ID NO: 4567 - RNA, 18 nt, artificial
  Chemically synthesized
agcaucauuguucucauc

SEQ ID NO: 4568 - RNA, 18 nt, artificial
  Chemically synthesized
cugggagaacuccgagca

SEQ ID NO: 4569 - RNA, 18 nt, artificial
  Chemically synthesized
aucccaacuagacaaaga

SEQ ID NO: 4570 - RNA, 18 nt, artificial
  Chemically synthesized
gucuugguguucauuauc

SEQ ID NO: 4571 - RNA, 18 nt, artificial
  Chemically synthesized
aucauagcagauguuccu

SEQ ID NO: 4572 - RNA, 18 nt, artificial
  Chemically synthesized
aguuuuucagagugagca

SEQ ID NO: 4573 - RNA, 18 nt, artificial
  Chemically synthesized
uuguuggacaggucaagg

SEQ ID NO: 4574 - RNA, 18 nt, artificial
  Chemically synthesized
aaguuucaggcauagaau

SEQ ID NO: 4575 - RNA, 18 nt, artificial
  Chemically synthesized
uaggacagagaaugccuu

SEQ ID NO: 4576 - RNA, 18 nt, artificial
  Chemically synthesized
uuuccagugucuugggaa

SEQ ID NO: 4577 - RNA, 18 nt, artificial
  Chemically synthesized
aaguccaguucauacuug

SEQ ID NO: 4578 - RNA, 18 nt, artificial
  Chemically synthesized
aauuuucacugagaucca

SEQ ID NO: 4579 - RNA, 18 nt, artificial
  Chemically synthesized
uaaggauuucccaguaag

SEQ ID NO: 4580 - RNA, 18 nt, artificial
  Chemically synthesized
uugcuccuuagaaaacgu

SEQ ID NO: 4581 - RNA, 18 nt, artificial
  Chemically synthesized
aagaaagaaugacacagu

SEQ ID NO: 4582 - RNA, 18 nt, artificial
  Chemically synthesized
augggcuccagaagaaug

SEQ ID NO: 4583 - RNA, 18 nt, artificial
  Chemically synthesized
gcagcaucauuguucuca

SEQ ID NO: 4584 - RNA, 18 nt, artificial
  Chemically synthesized
cuccuuagaaaacguagu

SEQ ID NO: 4585 - RNA, 18 nt, artificial
  Chemically synthesized
ugcugcuucauaugaagg

SEQ ID NO: 4586 - RNA, 18 nt, artificial
  Chemically synthesized
uggccacugacaaguuuc

SEQ ID NO: 4587 - RNA, 18 nt, artificial
  Chemically synthesized
gaacuuguaacaucuaca

SEQ ID NO: 4588 - RNA, 18 nt, artificial
  Chemically synthesized
gguucugcauccaugaag

SEQ ID NO: 4589 - RNA, 18 nt, artificial
  Chemically synthesized
uucacacaccucuguagg

SEQ ID NO: 4590 - RNA, 18 nt, artificial
  Chemically synthesized
agcuuccaaagucuucag

SEQ ID NO: 4591 - RNA, 18 nt, artificial
  Chemically synthesized
ugaucaugguuaucucau

SEQ ID NO: 4592 - RNA, 18 nt, artificial
  Chemically synthesized
ucagauuuacccaaaauc

SEQ ID NO: 4593 - RNA, 18 nt, artificial
  Chemically synthesized
uaccauugcggucacaag

SEQ ID NO: 4594 - RNA, 18 nt, artificial
  Chemically synthesized
guucugcauccaugaagu

SEQ ID NO: 4595 - RNA, 18 nt, artificial
  Chemically synthesized
aucaguaucucgcaguuc

SEQ ID NO: 4596 - RNA, 18 nt, artificial
  Chemically synthesized
guucauacuugcaccacu

SEQ ID NO: 4597 - RNA, 18 nt, artificial
  Chemically synthesized
cuguaagaaacaaaugca

SEQ ID NO: 4598 - RNA, 18 nt, artificial
  Chemically synthesized
uggagucaaugauauugu

SEQ ID NO: 4599 - RNA, 18 nt, artificial
  Chemically synthesized
cucuguagaucugaagca

SEQ ID NO: 4600 - RNA, 18 nt, artificial
  Chemically synthesized
uuacacuguguauucgug

SEQ ID NO: 4601 - RNA, 18 nt, artificial
  Chemically synthesized
ugccaaaugauuuugccu

SEQ ID NO: 4602 - RNA, 18 nt, artificial
  Chemically synthesized
uguuacacuguguauucg

SEQ ID NO: 4603 - RNA, 18 nt, artificial
  Chemically synthesized
cuuuuuucuaggaauagc

SEQ ID NO: 4604 - RNA, 18 nt, artificial
  Chemically synthesized
ugggauggagagucacac

SEQ ID NO: 4605 - RNA, 18 nt, artificial
  Chemically synthesized
aacaccaaacacugggag

SEQ ID NO: 4606 - RNA, 18 nt, artificial
  Chemically synthesized
gaugucagcaccagagcc

SEQ ID NO: 4607 - RNA, 18 nt, artificial
  Chemically synthesized
aaggaucagaugacuuac

SEQ ID NO: 4608 - RNA, 18 nt, artificial
  Chemically synthesized
uuaucuuccgcagcuugc

SEQ ID NO: 4609 - RNA, 18 nt, artificial
  Chemically synthesized
auaggaaauacacagcac

SEQ ID NO: 4610 - RNA, 18 nt, artificial
  Chemically synthesized
cugaaacaaacuuucauc

SEQ ID NO: 4611 - RNA, 18 nt, artificial
  Chemically synthesized
aguuucaggcauagaaug

SEQ ID NO: 4612 - RNA, 18 nt, artificial
  Chemically synthesized
aagucuucagugugugaa

SEQ ID NO: 4613 - RNA, 18 nt, artificial
  Chemically synthesized
aacgguggcacaggaccc

SEQ ID NO: 4614 - RNA, 18 nt, artificial
  Chemically synthesized
cucuguaggucacuguug

SEQ ID NO: 4615 - RNA, 18 nt, artificial
  Chemically synthesized
uuagcaggaagaaagaau

SEQ ID NO: 4616 - RNA, 18 nt, artificial
  Chemically synthesized
aauucacaggagcaaaug

SEQ ID NO: 4617 - RNA, 18 nt, artificial
  Chemically synthesized
uacagucaucaaacucua

SEQ ID NO: 4618 - RNA, 18 nt, artificial
  Chemically synthesized
uucaacccacaacuacca

SEQ ID NO: 4619 - RNA, 18 nt, artificial
  Chemically synthesized
aacuagacaaagacuggu

SEQ ID NO: 4620 - RNA, 18 nt, artificial
  Chemically synthesized
augagucaaguugcuccu

SEQ ID NO: 4621 - RNA, 18 nt, artificial
  Chemically synthesized
aaguuuuucagagugagc

SEQ ID NO: 4622 - RNA, 18 nt, artificial
  Chemically synthesized
cacuguguauucgugugc

SEQ ID NO: 4623 - RNA, 18 nt, artificial
  Chemically synthesized
ucuccgguuuuuuccaau

SEQ ID NO: 4624 - RNA, 18 nt, artificial
  Chemically synthesized
auuaccaacuccauuaag

SEQ ID NO: 4625 - RNA, 18 nt, artificial
  Chemically synthesized
ucaaguuccucaaggaag

SEQ ID NO: 4626 - RNA, 18 nt, artificial
  Chemically synthesized
auaaagaucccaacuaga

SEQ ID NO: 4627 - RNA, 18 nt, artificial
  Chemically synthesized
auuuacccaaaauccuuc

SEQ ID NO: 4628 - RNA, 18 nt, artificial
  Chemically synthesized
caggaaugaagucccgcu

SEQ ID NO: 4629 - RNA, 18 nt, artificial
  Chemically synthesized
ugacauuccgacaccgag

SEQ ID NO: 4630 - RNA, 18 nt, artificial
  Chemically synthesized
aagaaucuuccucuauug

SEQ ID NO: 4631 - RNA, 18 nt, artificial
  Chemically synthesized
cugcaaccaauucccuug

SEQ ID NO: 4632 - RNA, 18 nt, artificial
  Chemically synthesized
cagagcacagcacaugcc

SEQ ID NO: 4633 - RNA, 18 nt, artificial
  Chemically synthesized
agacccacaccauccaca

SEQ ID NO: 4634 - RNA, 18 nt, artificial
  Chemically synthesized
cuucugugagcccugagg

SEQ ID NO: 4635 - RNA, 18 nt, artificial
  Chemically synthesized
gaggcaucugguagaguc

SEQ ID NO: 4636 - RNA, 18 nt, artificial
  Chemically synthesized
cacugggagaacuccgag

SEQ ID NO: 4637 - RNA, 18 nt, artificial
  Chemically synthesized
agaugacuuacauucuga

SEQ ID NO: 4638 - RNA, 18 nt, artificial
  Chemically synthesized
gcaucauuguucucauca

SEQ ID NO: 4639 - RNA, 18 nt, artificial
  Chemically synthesized
ccacucucaggauuugca

SEQ ID NO: 4640 - RNA, 18 nt, artificial
  Chemically synthesized
gcuuaugaagacacaacu

SEQ ID NO: 4641 - RNA, 18 nt, artificial
  Chemically synthesized
guugcuccuuagaaaacg

SEQ ID NO: 4642 - RNA, 18 nt, artificial
  Chemically synthesized
gguuuuuuccaaugaugc

SEQ ID NO: 4643 - RNA, 18 nt, artificial
  Chemically synthesized
uguguauucgugugcugg

SEQ ID NO: 4644 - RNA, 18 nt, artificial
  Chemically synthesized
ucaugguuaucucauaga

SEQ ID NO: 4645 - RNA, 18 nt, artificial
  Chemically synthesized
cauucugaauugacuuca

SEQ ID NO: 4646 - RNA, 18 nt, artificial
  Chemically synthesized
agaaaaagaaucuuccuc

SEQ ID NO: 4647 - RNA, 18 nt, artificial
  Chemically synthesized
ucagaugacuuacauucu

SEQ ID NO: 4648 - RNA, 18 nt, artificial
  Chemically synthesized
agagcaaugggcacaaug

SEQ ID NO: 4649 - RNA, 18 nt, artificial
  Chemically synthesized
aggcauagaaugaaaacu

SEQ ID NO: 4650 - RNA, 18 nt, artificial
  Chemically synthesized
aguguccaaaucaguauc

SEQ ID NO: 4651 - RNA, 18 nt, artificial
  Chemically synthesized
auuuucauauaccacagg

SEQ ID NO: 4652 - RNA, 18 nt, artificial
  Chemically synthesized
ggaucagcaggaacagag

SEQ ID NO: 4653 - RNA, 18 nt, artificial
  Chemically synthesized
uggcagcaucauuguucu

SEQ ID NO: 4654 - RNA, 18 nt, artificial
  Chemically synthesized
agcccugagggaauggag

SEQ ID NO: 4655 - RNA, 18 nt, artificial
  Chemically synthesized
agucacacagguaauuug

SEQ ID NO: 4656 - RNA, 18 nt, artificial
  Chemically synthesized
uuaaggguacagucauca

SEQ ID NO: 4657 - RNA, 18 nt, artificial
  Chemically synthesized
acucuucacaaaguuuuc

SEQ ID NO: 4658 - RNA, 18 nt, artificial
  Chemically synthesized
auucccuuggauaccaag

SEQ ID NO: 4659 - RNA, 18 nt, artificial
  Chemically synthesized
agaagaaugagaauggca

SEQ ID NO: 4660 - RNA, 18 nt, artificial
  Chemically synthesized
ugaagacacaacuugaag

SEQ ID NO: 4661 - RNA, 18 nt, artificial
  Chemically synthesized
auccugcuugcaacacca

SEQ ID NO: 4662 - RNA, 18 nt, artificial
  Chemically synthesized
ugggcuuccuuuuggccu

SEQ ID NO: 4663 - RNA, 18 nt, artificial
  Chemically synthesized
guuccaaacauuccacgg

SEQ ID NO: 4664 - RNA, 18 nt, artificial
  Chemically synthesized
uauccauggguucugcau

SEQ ID NO: 4665 - RNA, 18 nt, artificial
  Chemically synthesized
gaucccaacuagacaaag

SEQ ID NO: 4666 - RNA, 18 nt, artificial
  Chemically synthesized
auacacagcacuuuuuuc

SEQ ID NO: 4667 - RNA, 18 nt, artificial
  Chemically synthesized
uguccauauuucccacuc

SEQ ID NO: 4668 - RNA, 18 nt, artificial
  Chemically synthesized
cauccaugaagucaacca

SEQ ID NO: 4669 - RNA, 18 nt, artificial
  Chemically synthesized
agcagugaaagagcaaug

SEQ ID NO: 4670 - RNA, 18 nt, artificial
  Chemically synthesized
gucaccugagagaacgcc

SEQ ID NO: 4671 - RNA, 18 nt, artificial
  Chemically synthesized
gauuguuaacguuuccac

SEQ ID NO: 4672 - RNA, 18 nt, artificial
  Chemically synthesized
aaugaagucccgcuuaug

SEQ ID NO: 4673 - RNA, 18 nt, artificial
  Chemically synthesized
auccuucccgcugagccu

SEQ ID NO: 4674 - RNA, 18 nt, artificial
  Chemically synthesized
acucucaggauuugcaau

SEQ ID NO: 4675 - RNA, 18 nt, artificial
  Chemically synthesized
agauuuacccaaaauccu

SEQ ID NO: 4676 - RNA, 18 nt, artificial
  Chemically synthesized
uuccaaagucuucagugu

SEQ ID NO: 4677 - RNA, 18 nt, artificial
  Chemically synthesized
uucuuccuuggagaggcu

SEQ ID NO: 4678 - RNA, 18 nt, artificial
  Chemically synthesized
uugcucuugagaucagcu

SEQ ID NO: 4679 - RNA, 18 nt, artificial
  Chemically synthesized
agucaaguugcuccuuag

SEQ ID NO: 4680 - RNA, 18 nt, artificial
  Chemically synthesized
cugugauucuuuuaacuc

SEQ ID NO: 4681 - RNA, 18 nt, artificial
  Chemically synthesized
auuggaugucagcaccag

SEQ ID NO: 4682 - RNA, 18 nt, artificial
  Chemically synthesized
uuggagaggcugaugaug

SEQ ID NO: 4683 - RNA, 18 nt, artificial
  Chemically synthesized
agguguccauauuuccca

SEQ ID NO: 4684 - RNA, 18 nt, artificial
  Chemically synthesized
uccaugaagucaaccaac

SEQ ID NO: 4685 - RNA, 18 nt, artificial
  Chemically synthesized
agaacgccgagcagccgc

SEQ ID NO: 4686 - RNA, 18 nt, artificial
  Chemically synthesized
uaauguaggugauccugu

SEQ ID NO: 4687 - RNA, 18 nt, artificial
  Chemically synthesized
gcucuguagaucugaagc

SEQ ID NO: 4688 - RNA, 18 nt, artificial
  Chemically synthesized
gucaaccaacuguggauc

SEQ ID NO: 4689 - RNA, 18 nt, artificial
  Chemically synthesized
guaacauggguaagaggg

SEQ ID NO: 4690 - RNA, 18 nt, artificial
  Chemically synthesized
gaagaaugagaauggcag

SEQ ID NO: 4691 - RNA, 18 nt, artificial
  Chemically synthesized
guacauccacguaguuuu

SEQ ID NO: 4692 - RNA, 18 nt, artificial
  Chemically synthesized
uagaucugaagcaucaau

SEQ ID NO: 4693 - RNA, 18 nt, artificial
  Chemically synthesized
cacagagaagugacagcu

SEQ ID NO: 4694 - RNA, 18 nt, artificial
  Chemically synthesized
uugccaccagcuuccaaa

SEQ ID NO: 4695 - RNA, 18 nt, artificial
  Chemically synthesized
ugcccuugcagauaccau

SEQ ID NO: 4696 - RNA, 18 nt, artificial
  Chemically synthesized
gucacuauaggucuccuu

SEQ ID NO: 4697 - RNA, 18 nt, artificial
  Chemically synthesized
aagugacagcuagguagg

SEQ ID NO: 4698 - RNA, 18 nt, artificial
  Chemically synthesized
gagaagccugauuggagg

SEQ ID NO: 4699 - RNA, 18 nt, artificial
  Chemically synthesized
uuccacggaacuuguaac

SEQ ID NO: 4700 - RNA, 18 nt, artificial
  Chemically synthesized
gagucucuuagcaggaag

SEQ ID NO: 4701 - RNA, 18 nt, artificial
  Chemically synthesized
augacgguacauccacgu

SEQ ID NO: 4702 - RNA, 18 nt, artificial
  Chemically synthesized
cagcaucauuguucucau

SEQ ID NO: 4703 - RNA, 18 nt, artificial
  Chemically synthesized
uugcaccacucacucuuc

SEQ ID NO: 4704 - RNA, 18 nt, artificial
  Chemically synthesized
uugcauuccuacugauuu

SEQ ID NO: 4705 - RNA, 18 nt, artificial
  Chemically synthesized
agagaagugacagcuagg

SEQ ID NO: 4706 - RNA, 18 nt, artificial
  Chemically synthesized
gagaaguccaguucauac

SEQ ID NO: 4707 - RNA, 18 nt, artificial
  Chemically synthesized
cgcuuucucgcugccucc

SEQ ID NO: 4708 - RNA, 18 nt, artificial
  Chemically synthesized
gaacgccgagcagccgcc

SEQ ID NO: 4709 - RNA, 18 nt, artificial
  Chemically synthesized
uuccgacaccgagaggcg

SEQ ID NO: 4710 - RNA, 18 nt, artificial
  Chemically synthesized
aaagcacaaagacaguuu

SEQ ID NO: 4711 - RNA, 18 nt, artificial
  Chemically synthesized
cacucacucuucacaaag

SEQ ID NO: 4712 - RNA, 18 nt, artificial
  Chemically synthesized
accucuguaggucacugu

SEQ ID NO: 4713 - RNA, 18 nt, artificial
  Chemically synthesized
ccgcucacuguaagaaac

SEQ ID NO: 4714 - RNA, 18 nt, artificial
  Chemically synthesized
gaugcucuaaaauuacca

SEQ ID NO: 4715 - RNA, 18 nt, artificial
  Chemically synthesized
gaaaaaagagauguuucc

SEQ ID NO: 4716 - RNA, 18 nt, artificial
  Chemically synthesized
gaggauucuuccuuggag

SEQ ID NO: 4717 - RNA, 18 nt, artificial
  Chemically synthesized
uccagguaggucuuggug

SEQ ID NO: 4718 - RNA, 18 nt, artificial
  Chemically synthesized
augaagucaaccaacugu

SEQ ID NO: 4719 - RNA, 18 nt, artificial
  Chemically synthesized
gaggagucucuuagcagg

SEQ ID NO: 4720 - RNA, 18 nt, artificial
  Chemically synthesized
gugaauauaaagugcuca

SEQ ID NO: 4721 - RNA, 18 nt, artificial
  Chemically synthesized
ggucuccuuuggauccug

SEQ ID NO: 4722 - RNA, 18 nt, artificial
  Chemically synthesized
ugugugaaaugagucaag

SEQ ID NO: 4723 - RNA, 18 nt, artificial
  Chemically synthesized
uggccacagaggagucuc

SEQ ID NO: 4724 - RNA, 18 nt, artificial
  Chemically synthesized
cucacuguaagaaacaaa

SEQ ID NO: 4725 - RNA, 18 nt, artificial
  Chemically synthesized
aaugggcacaaugagccc

SEQ ID NO: 4726 - RNA, 18 nt, artificial
  Chemically synthesized
caccagcuuccaaagucu

SEQ ID NO: 4727 - RNA, 18 nt, artificial
  Chemically synthesized
ugacagcuagguaggaca

SEQ ID NO: 4728 - RNA, 18 nt, artificial
  Chemically synthesized
acugagauccaaguauuc

SEQ ID NO: 4729 - RNA, 18 nt, artificial
  Chemically synthesized
cacaugggauggagaguc

SEQ ID NO: 4730 - RNA, 18 nt, artificial
  Chemically synthesized
acauuccgacaccgagag

SEQ ID NO: 4731 - RNA, 18 nt, artificial
  Chemically synthesized
uugcuaauguaggugauc

SEQ ID NO: 4732 - RNA, 18 nt, artificial
  Chemically synthesized
uuucaucuuuucuggcca

SEQ ID NO: 4733 - RNA, 18 nt, artificial
  Chemically synthesized
ucuguagaucugaagcau

SEQ ID NO: 4734 - RNA, 18 nt, artificial
  Chemically synthesized
ucagcugcacagagaagu

SEQ ID NO: 4735 - RNA, 18 nt, artificial
  Chemically synthesized
agugucuugggaaugcag

SEQ ID NO: 4736 - RNA, 18 nt, artificial
  Chemically synthesized
uuccauuggaugucagca

SEQ ID NO: 4737 - RNA, 18 nt, artificial
  Chemically synthesized
uuuguuucaccaguggau

SEQ ID NO: 4738 - RNA, 18 nt, artificial
  Chemically synthesized
uguagaucugaagcauca

SEQ ID NO: 4739 - RNA, 18 nt, artificial
  Chemically synthesized
aggcugaauuuuucaagu

SEQ ID NO: 4740 - RNA, 18 nt, artificial
  Chemically synthesized
caguuccaaacauuccac

SEQ ID NO: 4741 - RNA, 18 nt, artificial
  Chemically synthesized
acagcacaugccagacac

SEQ ID NO: 4742 - RNA, 18 nt, artificial
  Chemically synthesized
cagucaucaaacucuaau

SEQ ID NO: 4743 - RNA, 18 nt, artificial
  Chemically synthesized
guguucauuaucuuccgc

SEQ ID NO: 4744 - RNA, 18 nt, artificial
  Chemically synthesized
ugaagguguccauauuuc

SEQ ID NO: 4745 - RNA, 18 nt, artificial
  Chemically synthesized
gcuccuggaccauaaggu

SEQ ID NO: 4746 - RNA, 18 nt, artificial
  Chemically synthesized
cagggaagaaaaagaauc

SEQ ID NO: 4747 - RNA, 18 nt, artificial
  Chemically synthesized
cugggcuuccuuuuggcc

SEQ ID NO: 4748 - RNA, 18 nt, artificial
  Chemically synthesized
acggaacuuguaacaucu

SEQ ID NO: 4749 - RNA, 18 nt, artificial
  Chemically synthesized
uugucaaugauccacuug

SEQ ID NO: 4750 - RNA, 18 nt, artificial
  Chemically synthesized
gaaucuuccucuauugug

SEQ ID NO: 4751 - RNA, 18 nt, artificial
  Chemically synthesized
ucuauauccauggguucu

SEQ ID NO: 4752 - RNA, 18 nt, artificial
  Chemically synthesized
cucugucauuaucagaug

SEQ ID NO: 4753 - RNA, 18 nt, artificial
  Chemically synthesized
uuuuuacagcuucuguga

SEQ ID NO: 4754 - RNA, 18 nt, artificial
  Chemically synthesized
aaggcuuuuuacagcuuc

SEQ ID NO: 4755 - RNA, 18 nt, artificial
  Chemically synthesized
cuccagguaggucuuggu

SEQ ID NO: 4756 - RNA, 18 nt, artificial
  Chemically synthesized
caggaagaaagaaugaca

SEQ ID NO: 4757 - RNA, 18 nt, artificial
  Chemically synthesized
caucuaaaauuuccagug

SEQ ID NO: 4758 - RNA, 18 nt, artificial
  Chemically synthesized
aguucuccagcuccugga

SEQ ID NO: 4759 - RNA, 18 nt, artificial
  Chemically synthesized
acucuuucuguaagugaa

SEQ ID NO: 4760 - RNA, 18 nt, artificial
  Chemically synthesized
ggauuugcaauuuuguga

SEQ ID NO: 4761 - RNA, 18 nt, artificial
  Chemically synthesized
auuaaggguacagucauc

SEQ ID NO: 4762 - RNA, 18 nt, artificial
  Chemically synthesized
ucuuccgcagcuugcaga

SEQ ID NO: 4763 - RNA, 18 nt, artificial
  Chemically synthesized
aguugcuacagauuacag

SEQ ID NO: 4764 - RNA, 18 nt, artificial
  Chemically synthesized
augacacagucauugaga

SEQ ID NO: 4765 - RNA, 18 nt, artificial
  Chemically synthesized
uaguaacauggguaagag

SEQ ID NO: 4766 - RNA, 18 nt, artificial
  Chemically synthesized
ggaauggcuuuuuucuca

SEQ ID NO: 4767 - RNA, 18 nt, artificial
  Chemically synthesized
cauaaagaucccaacuag

SEQ ID NO: 4768 - RNA, 18 nt, artificial
  Chemically synthesized
guagagucaucaacuuau

SEQ ID NO: 4769 - RNA, 18 nt, artificial
  Chemically synthesized
cugagauccaaguauucu

SEQ ID NO: 4770 - RNA, 18 nt, artificial
  Chemically synthesized
aagucaaccaacugugga

SEQ ID NO: 4771 - RNA, 18 nt, artificial
  Chemically synthesized
gacuuaugaucaugguua

SEQ ID NO: 4772 - RNA, 18 nt, artificial
  Chemically synthesized
cuccauuaaggguacagu

SEQ ID NO: 4773 - RNA, 18 nt, artificial
  Chemically synthesized
cgcuuaugaagacacaac

SEQ ID NO: 4774 - RNA, 18 nt, artificial
  Chemically synthesized
ucagcaggaacagagcac

SEQ ID NO: 4775 - RNA, 18 nt, artificial
  Chemically synthesized
cauccugaaccugcuggc

SEQ ID NO: 4776 - RNA, 18 nt, artificial
  Chemically synthesized
cuguugcuaauguaggug

SEQ ID NO: 4777 - RNA, 18 nt, artificial
  Chemically synthesized
uuuaucgcagcucucaga

SEQ ID NO: 4778 - RNA, 18 nt, artificial
  Chemically synthesized
auccugagcugcccuugc

SEQ ID NO: 4779 - RNA, 18 nt, artificial
  Chemically synthesized
ugcacagagaagugacag

SEQ ID NO: 4780 - RNA, 18 nt, artificial
  Chemically synthesized
ugaugccaaaugauuuug

SEQ ID NO: 4781 - RNA, 18 nt, artificial
  Chemically synthesized
cagugaaagagcaauggg

SEQ ID NO: 4782 - RNA, 18 nt, artificial
  Chemically synthesized
uucauaugaaggaucaga

SEQ ID NO: 4783 - RNA, 18 nt, artificial
  Chemically synthesized
agacaguuuuguggcucu

SEQ ID NO: 4784 - RNA, 18 nt, artificial
  Chemically synthesized
aguucauacuugcaccac

SEQ ID NO: 4785 - RNA, 18 nt, artificial
  Chemically synthesized
ucuaaaauuuccaguguc

SEQ ID NO: 4786 - RNA, 18 nt, artificial
  Chemically synthesized
guucuuugaguugcggca

SEQ ID NO: 4787 - RNA, 18 nt, artificial
  Chemically synthesized
guuuguagagagggccag

SEQ ID NO: 4788 - RNA, 18 nt, artificial
  Chemically synthesized
cucuauauccauggguuc

SEQ ID NO: 4789 - RNA, 18 nt, artificial
  Chemically synthesized
accgagaggcggacaucc

SEQ ID NO: 4790 - RNA, 18 nt, artificial
  Chemically synthesized
caucaaauuuucacugag

SEQ ID NO: 4791 - RNA, 18 nt, artificial
  Chemically synthesized
cacaaagacaguuuugug

SEQ ID NO: 4792 - RNA, 18 nt, artificial
  Chemically synthesized
auuguccagugcuucaac

SEQ ID NO: 4793 - RNA, 18 nt, artificial
  Chemically synthesized
aacguaguuauugcauuc

SEQ ID NO: 4794 - RNA, 18 nt, artificial
  Chemically synthesized
uccuggaccauaagguuc

SEQ ID NO: 4795 - RNA, 18 nt, artificial
  Chemically synthesized
caaucaaucaagacuuug

SEQ ID NO: 4796 - RNA, 18 nt, artificial
  Chemically synthesized
acagagcacagcacaugc

SEQ ID NO: 4797 - RNA, 18 nt, artificial
  Chemically synthesized
aaaguaaacaaggaacca

SEQ ID NO: 4798 - RNA, 18 nt, artificial
  Chemically synthesized
acuccgagcagucaccug

SEQ ID NO: 4799 - RNA, 18 nt, artificial
  Chemically synthesized
agcaucaaucucaaguuc

SEQ ID NO: 4800 - RNA, 18 nt, artificial
  Chemically synthesized
auagcagauguuccugcu

SEQ ID NO: 4801 - RNA, 18 nt, artificial
  Chemically synthesized
augcaucauagcagaugu

SEQ ID NO: 4802 - RNA, 18 nt, artificial
  Chemically synthesized
agucaaccaacuguggau

SEQ ID NO: 4803 - RNA, 18 nt, artificial
  Chemically synthesized
aaugggagaaguccaguu

SEQ ID NO: 4804 - RNA, 18 nt, artificial
  Chemically synthesized
accaguggauaguucuga

SEQ ID NO: 4805 - RNA, 18 nt, artificial
  Chemically synthesized
uuuuguggcucuuuucaa

SEQ ID NO: 4806 - RNA, 18 nt, artificial
  Chemically synthesized
gucuaaauguucaagacu

SEQ ID NO: 4807 - RNA, 18 nt, artificial
  Chemically synthesized
uaggguuuuguaaggauu

SEQ ID NO: 4808 - RNA, 18 nt, artificial
  Chemically synthesized
aggauucuuccuuggaga

SEQ ID NO: 4809 - RNA, 18 nt, artificial
  Chemically synthesized
agccugauuggaggauuc

SEQ ID NO: 4810 - RNA, 18 nt, artificial
  Chemically synthesized
gaauggaguuuaaagauc

SEQ ID NO: 4811 - RNA, 18 nt, artificial
  Chemically synthesized
accaauucccuuggauac

SEQ ID NO: 4812 - RNA, 18 nt, artificial
  Chemically synthesized
gaauaugcagccuccgga

SEQ ID NO: 4813 - RNA, 18 nt, artificial
  Chemically synthesized
agggaauggaguuuaaag

SEQ ID NO: 4814 - RNA, 18 nt, artificial
  Chemically synthesized
gaaaaagaaucuuccucu

SEQ ID NO: 4815 - RNA, 18 nt, artificial
  Chemically synthesized
uaauuugcuggccaauca

SEQ ID NO: 4816 - RNA, 18 nt, artificial
  Chemically synthesized
cuuuaucgcagcucucag

SEQ ID NO: 4817 - RNA, 18 nt, artificial
  Chemically synthesized
aauuuguuucaccagugg

SEQ ID NO: 4818 - RNA, 18 nt, artificial
  Chemically synthesized
acuguguauucgugugcu

SEQ ID NO: 4819 - RNA, 18 nt, artificial
  Chemically synthesized
aauagcaacaaguuuugg

SEQ ID NO: 4820 - RNA, 18 nt, artificial
  Chemically synthesized
cucuaaaauuaccaacuc

SEQ ID NO: 4821 - RNA, 18 nt, artificial
  Chemically synthesized
aaauccuucccgcugagc

SEQ ID NO: 4822 - RNA, 18 nt, artificial
  Chemically synthesized
cuuucaucggugauuuuc

SEQ ID NO: 4823 - RNA, 18 nt, artificial
  Chemically synthesized
gucauugagaaucuuaag

SEQ ID NO: 4824 - RNA, 18 nt, artificial
  Chemically synthesized
uucugcauccaugaaguc

SEQ ID NO: 4825 - RNA, 18 nt, artificial
  Chemically synthesized
cuugcagauaccauugcg

SEQ ID NO: 4826 - RNA, 18 nt, artificial
  Chemically synthesized
cagcuagguaggacagag

SEQ ID NO: 4827 - RNA, 18 nt, artificial
  Chemically synthesized
aguugaaagcagugaaag

SEQ ID NO: 4828 - RNA, 18 nt, artificial
  Chemically synthesized
ucaaggaagguaagucca

SEQ ID NO: 4829 - RNA, 18 nt, artificial
  Chemically synthesized
acuguugcuaauguaggu

SEQ ID NO: 4830 - RNA, 18 nt, artificial
  Chemically synthesized
uggucuuaaauaugggaa

SEQ ID NO: 4831 - RNA, 18 nt, artificial
  Chemically synthesized
accagaaaaacuuuacug

SEQ ID NO: 4832 - RNA, 18 nt, artificial
  Chemically synthesized
uaggugauccuguuguug

SEQ ID NO: 4833 - RNA, 18 nt, artificial
  Chemically synthesized
agugaauauaaagugcuc

SEQ ID NO: 4834 - RNA, 18 nt, artificial
  Chemically synthesized
uuguugcucuugagauca

SEQ ID NO: 4835 - RNA, 18 nt, artificial
  Chemically synthesized
aaggaaccagaaaaacuu

SEQ ID NO: 4836 - RNA, 18 nt, artificial
  Chemically synthesized
aaguguccaaaucaguau

SEQ ID NO: 4837 - RNA, 18 nt, artificial
  Chemically synthesized
auggaaaguguccaaauc

SEQ ID NO: 4838 - RNA, 18 nt, artificial
  Chemically synthesized
agagcacagcacaugcca

SEQ ID NO: 4839 - RNA, 18 nt, artificial
  Chemically synthesized
ucauuaucagaugcucua

SEQ ID NO: 4840 - RNA, 18 nt, artificial
  Chemically synthesized
agagcuccugggagucac

SEQ ID NO: 4841 - RNA, 18 nt, artificial
  Chemically synthesized
gagcuuuccugggcuucc

SEQ ID NO: 4842 - RNA, 18 nt, artificial
  Chemically synthesized
cucacaggcugaauuuuu

SEQ ID NO: 4843 - RNA, 18 nt, artificial
  Chemically synthesized
ugaacuaagccaguugcu

SEQ ID NO: 4844 - RNA, 18 nt, artificial
  Chemically synthesized
uaugcugcuucauaugaa

SEQ ID NO: 4845 - RNA, 18 nt, artificial
  Chemically synthesized
ugagaugagaaaaaagag

SEQ ID NO: 4846 - RNA, 18 nt, artificial
  Chemically synthesized
cacccaguaggcaucccg

SEQ ID NO: 4847 - RNA, 18 nt, artificial
  Chemically synthesized
agccuguuacacugugua

SEQ ID NO: 4848 - RNA, 18 nt, artificial
  Chemically synthesized
uuaaguucauuugugcug

SEQ ID NO: 4849 - RNA, 18 nt, artificial
  Chemically synthesized
ugaaaaauggaaaguguc

SEQ ID NO: 4850 - RNA, 18 nt, artificial
  Chemically synthesized
cggaaaugggagaagucc

SEQ ID NO: 4851 - RNA, 18 nt, artificial
  Chemically synthesized
uuucaggcauagaaugaa

SEQ ID NO: 4852 - RNA, 18 nt, artificial
  Chemically synthesized
aacaaacuuucaucggug

SEQ ID NO: 4853 - RNA, 18 nt, artificial
  Chemically synthesized
ucacacagguaauuugcu

SEQ ID NO: 4854 - RNA, 18 nt, artificial
  Chemically synthesized
ugaagcaucaaucucaag

SEQ ID NO: 4855 - RNA, 18 nt, artificial
  Chemically synthesized
guucugaaaaauggaaag

SEQ ID NO: 4856 - RNA, 18 nt, artificial
  Chemically synthesized
ggagaacuccgagcaguc

SEQ ID NO: 4857 - RNA, 18 nt, artificial
  Chemically synthesized
ccaggaaugaagucccgc

SEQ ID NO: 4858 - RNA, 18 nt, artificial
  Chemically synthesized
cuuggucacuaagagcuc

SEQ ID NO: 4859 - RNA, 18 nt, artificial
  Chemically synthesized
caaguccucaaaugacgg

SEQ ID NO: 4860 - RNA, 18 nt, artificial
  Chemically synthesized
aacccacaacuaccaguu

SEQ ID NO: 4861 - RNA, 18 nt, artificial
  Chemically synthesized
uggcucuuuucaauggag

SEQ ID NO: 4862 - RNA, 18 nt, artificial
  Chemically synthesized
gaucuauaacucugucau

SEQ ID NO: 4863 - RNA, 18 nt, artificial
  Chemically synthesized
uccagcaguaaaauaugc

SEQ ID NO: 4864 - RNA, 18 nt, artificial
  Chemically synthesized
gaaaugggagaaguccag

SEQ ID NO: 4865 - RNA, 18 nt, artificial
  Chemically synthesized
agauguuccugcugggag

SEQ ID NO: 4866 - RNA, 18 nt, artificial
  Chemically synthesized
aaucucaaguuccucaag

SEQ ID NO: 4867 - RNA, 18 nt, artificial
  Chemically synthesized
aaaaauggaaagugucca

SEQ ID NO: 4868 - RNA, 18 nt, artificial
  Chemically synthesized
ccaauucccuuggauacc

SEQ ID NO: 4869 - RNA, 18 nt, artificial
  Chemically synthesized
ccaauuuuuaaaucuggc

SEQ ID NO: 4870 - RNA, 18 nt, artificial
  Chemically synthesized
ccaacuccauuaagggua

SEQ ID NO: 4871 - RNA, 18 nt, artificial
  Chemically synthesized
augaauuuguuucaccag

SEQ ID NO: 4872 - RNA, 18 nt, artificial
  Chemically synthesized
cagauaccauugcgguca

SEQ ID NO: 4873 - RNA, 18 nt, artificial
  Chemically synthesized
ugcaaccaauucccuugg

SEQ ID NO: 4874 - RNA, 18 nt, artificial
  Chemically synthesized
uuccuuggagaggcugau

SEQ ID NO: 4875 - RNA, 18 nt, artificial
  Chemically synthesized
agcucucagauuuaccca

SEQ ID NO: 4876 - RNA, 18 nt, artificial
  Chemically synthesized
augaaguuauugccacca

SEQ ID NO: 4877 - RNA, 18 nt, artificial
  Chemically synthesized
ugcuguccugugacauuc

SEQ ID NO: 4878 - RNA, 18 nt, artificial
  Chemically synthesized
aauacuaguaacaugggu

SEQ ID NO: 4879 - RNA, 18 nt, artificial
  Chemically synthesized
ugcuguuuccuaaugaac

SEQ ID NO: 4880 - RNA, 18 nt, artificial
  Chemically synthesized
aucuacaaaaaucuccag

SEQ ID NO: 4881 - RNA, 18 nt, artificial
  Chemically synthesized
auugagauuguuguugcu

SEQ ID NO: 4882 - RNA, 18 nt, artificial
  Chemically synthesized
uucacaggagcaaaugaa

SEQ ID NO: 4883 - RNA, 18 nt, artificial
  Chemically synthesized
gcaaugggcacaaugagc

SEQ ID NO: 4884 - RNA, 18 nt, artificial
  Chemically synthesized
ugcuggccacgcacaugg

SEQ ID NO: 4885 - RNA, 18 nt, artificial
  Chemically synthesized
aggccauggaaacggugg

SEQ ID NO: 4886 - RNA, 18 nt, artificial
  Chemically synthesized
gauucuuccuuggagagg

SEQ ID NO: 4887 - RNA, 18 nt, artificial
  Chemically synthesized
uuggaugucagcaccaga

SEQ ID NO: 4888 - RNA, 18 nt, artificial
  Chemically synthesized
ucucaaguuccucaagga

SEQ ID NO: 4889 - RNA, 18 nt, artificial
  Chemically synthesized
aacuccgagcagucaccu

SEQ ID NO: 4890 - RNA, 18 nt, artificial
  Chemically synthesized
uuugccuuguugcucuug

SEQ ID NO: 4891 - RNA, 18 nt, artificial
  Chemically synthesized
agguaccuucacuugguc

SEQ ID NO: 4892 - RNA, 18 nt, artificial
  Chemically synthesized
acauccugaaccugcugg

SEQ ID NO: 4893 - RNA, 18 nt, artificial
  Chemically synthesized
ugugacauuccgacaccg

SEQ ID NO: 4894 - RNA, 18 nt, artificial
  Chemically synthesized
guuuaaagauccugagcu

SEQ ID NO: 4895 - RNA, 18 nt, artificial
  Chemically synthesized
caugaagucaaccaacug

SEQ ID NO: 4896 - RNA, 18 nt, artificial
  Chemically synthesized
gcaucugguagagucauc

SEQ ID NO: 4897 - RNA, 18 nt, artificial
  Chemically synthesized
aauaugcagccuccggau

SEQ ID NO: 4898 - RNA, 18 nt, artificial
  Chemically synthesized
ggaagaaaaagaaucuuc

SEQ ID NO: 4899 - RNA, 18 nt, artificial
  Chemically synthesized
uauguggcauuguccagu

SEQ ID NO: 4900 - RNA, 18 nt, artificial
  Chemically synthesized
caaggaaccagaaaaacu

SEQ ID NO: 4901 - RNA, 18 nt, artificial
  Chemically synthesized
agacggaaaugggagaag

SEQ ID NO: 4902 - RNA, 18 nt, artificial
  Chemically synthesized
uagagagggccaggcauc

SEQ ID NO: 4903 - RNA, 18 nt, artificial
  Chemically synthesized
agcugcccuugcagauac

SEQ ID NO: 4904 - RNA, 18 nt, artificial
  Chemically synthesized
aacagagcacagcacaug

SEQ ID NO: 4905 - RNA, 18 nt, artificial
  Chemically synthesized
aaacaaacuuucaucggu

SEQ ID NO: 4906 - RNA, 18 nt, artificial
  Chemically synthesized
uucacuuggucacuaaga

SEQ ID NO: 4907 - RNA, 18 nt, artificial
  Chemically synthesized
accagagccuggagguuc

SEQ ID NO: 4908 - RNA, 18 nt, artificial
  Chemically synthesized
auccacuugccaggaaug

SEQ ID NO: 4909 - RNA, 18 nt, artificial
  Chemically synthesized
ucucuuagcaggaagaaa

SEQ ID NO: 4910 - RNA, 18 nt, artificial
  Chemically synthesized
aaugagaauggcagcauc

SEQ ID NO: 4911 - RNA, 18 nt, artificial
  Chemically synthesized
auagcucuguagaucuga

SEQ ID NO: 4912 - RNA, 18 nt, artificial
  Chemically synthesized
ucaaguugcuccuuagaa

SEQ ID NO: 4913 - RNA, 18 nt, artificial
  Chemically synthesized
caccucuguaggucacug

SEQ ID NO: 4914 - RNA, 18 nt, artificial
  Chemically synthesized
ugccuuuuguggccacag

SEQ ID NO: 4915 - RNA, 18 nt, artificial
  Chemically synthesized
uaaagugcucagaucaua

SEQ ID NO: 4916 - RNA, 18 nt, artificial
  Chemically synthesized
ugggagaacuccgagcag

SEQ ID NO: 4917 - RNA, 18 nt, artificial
  Chemically synthesized
gagcaaaugaaguuauug

SEQ ID NO: 4918 - RNA, 18 nt, artificial
  Chemically synthesized
acuugccaggaaugaagu

SEQ ID NO: 4919 - RNA, 18 nt, artificial
  Chemically synthesized
aacuguggaucaaaagua

SEQ ID NO: 4920 - RNA, 18 nt, artificial
  Chemically synthesized
gucacuaagagcuccugg

SEQ ID NO: 4921 - RNA, 18 nt, artificial
  Chemically synthesized
uguccugugacauuccga

SEQ ID NO: 4922 - RNA, 18 nt, artificial
  Chemically synthesized
gccagugcuugcugcucc

SEQ ID NO: 4923 - RNA, 18 nt, artificial
  Chemically synthesized
acaaaguuuucagaaagc

SEQ ID NO: 4924 - RNA, 18 nt, artificial
  Chemically synthesized
ggaauagcaacaaguuuu

SEQ ID NO: 4925 - RNA, 18 nt, artificial
  Chemically synthesized
uguaggucacuguugcua

SEQ ID NO: 4926 - RNA, 18 nt, artificial
  Chemically synthesized
ugcuggauaaguucaaau

SEQ ID NO: 4927 - RNA, 18 nt, artificial
  Chemically synthesized
gcaaguccucaaaugacg

SEQ ID NO: 4928 - RNA, 18 nt, artificial
  Chemically synthesized
cuccgagcagucaccuga

SEQ ID NO: 4929 - RNA, 18 nt, artificial
  Chemically synthesized
uaaugaacuaagccaguu

SEQ ID NO: 4930 - RNA, 18 nt, artificial
  Chemically synthesized
gcaggaagaaagaaugac

SEQ ID NO: 4931 - RNA, 18 nt, artificial
  Chemically synthesized
ucuugagaucagcugcac

SEQ ID NO: 4932 - RNA, 18 nt, artificial
  Chemically synthesized
acggaaaugggagaaguc

SEQ ID NO: 4933 - RNA, 18 nt, artificial
  Chemically synthesized
ucaaggcuuuuuacagcu

SEQ ID NO: 4934 - RNA, 18 nt, artificial
  Chemically synthesized
uacaaaaaucuccagcag

SEQ ID NO: 4935 - RNA, 18 nt, artificial
  Chemically synthesized
caucaaucucaaguuccu

SEQ ID NO: 4936 - RNA, 18 nt, artificial
  Chemically synthesized
gaucugaagcaucaaucu

SEQ ID NO: 4937 - RNA, 18 nt, artificial
  Chemically synthesized
guucacacaccucuguag

SEQ ID NO: 4938 - RNA, 18 nt, artificial
  Chemically synthesized
agucacuauaggucuccu

SEQ ID NO: 4939 - RNA, 18 nt, artificial
  Chemically synthesized
uugagauuguuguugcua

SEQ ID NO: 4940 - RNA, 18 nt, artificial
  Chemically synthesized
uggaucuauaacucuguc

SEQ ID NO: 4941 - RNA, 18 nt, artificial
  Chemically synthesized
cccuugcagauaccauug

SEQ ID NO: 4942 - RNA, 18 nt, artificial
  Chemically synthesized
aagaaugagaauggcagc

SEQ ID NO: 4943 - RNA, 18 nt, artificial
  Chemically synthesized
gcagugaaagagcaaugg

SEQ ID NO: 4944 - RNA, 18 nt, artificial
  Chemically synthesized
acauggguaagagggagg

SEQ ID NO: 4945 - RNA, 18 nt, artificial
  Chemically synthesized
auaugaaggaucagauga

SEQ ID NO: 4946 - RNA, 18 nt, artificial
  Chemically synthesized
guaaaaccuuggaauaug

SEQ ID NO: 4947 - RNA, 18 nt, artificial
  Chemically synthesized
uaccaguugaaagcagug

SEQ ID NO: 4948 - RNA, 18 nt, artificial
  Chemically synthesized
uccuuagaaaacguaguu

SEQ ID NO: 4949 - RNA, 18 nt, artificial
  Chemically synthesized
ugaaguuauugccaccag

SEQ ID NO: 4950 - RNA, 18 nt, artificial
  Chemically synthesized
ugcuugcaacaccaaaca

SEQ ID NO: 4951 - RNA, 18 nt, artificial
  Chemically synthesized
cagaggagucucuuagca

SEQ ID NO: 4952 - RNA, 18 nt, artificial
  Chemically synthesized
caaugaugccaaaugauu

SEQ ID NO: 4953 - RNA, 18 nt, artificial
  Chemically synthesized
auccucacaggcugaauu

SEQ ID NO: 4954 - RNA, 18 nt, artificial
  Chemically synthesized
caacuccauuaaggguac

SEQ ID NO: 4955 - RNA, 18 nt, artificial
  Chemically synthesized
aagacccacaccauccac

SEQ ID NO: 4956 - RNA, 18 nt, artificial
  Chemically synthesized
cugcugggagcuuuccug

SEQ ID NO: 4957 - RNA, 18 nt, artificial
  Chemically synthesized
ugucagcaccagagccug

SEQ ID NO: 4958 - RNA, 18 nt, artificial
  Chemically synthesized
agcaaagucucuccgguu

SEQ ID NO: 4959 - RNA, 18 nt, artificial
  Chemically synthesized
ccaguaaguuuaagaaug

SEQ ID NO: 4960 - RNA, 18 nt, artificial
  Chemically synthesized
aggaagguaaguccagca

SEQ ID NO: 4961 - RNA, 18 nt, artificial
  Chemically synthesized
aaagacaguuuuguggcu

SEQ ID NO: 4962 - RNA, 18 nt, artificial
  Chemically synthesized
caaguuucaggcauagaa

SEQ ID NO: 4963 - RNA, 18 nt, artificial
  Chemically synthesized
acuaccaguugaaagcag

SEQ ID NO: 4964 - RNA, 18 nt, artificial
  Chemically synthesized
acaugccagacaccagug

SEQ ID NO: 4965 - RNA, 18 nt, artificial
  Chemically synthesized
aaaguguccaaaucagua

SEQ ID NO: 4966 - RNA, 18 nt, artificial
  Chemically synthesized
aguccagcaaaaucuuuu

SEQ ID NO: 4967 - RNA, 18 nt, artificial
  Chemically synthesized
cucucaggauuugcaauu

SEQ ID NO: 4968 - RNA, 18 nt, artificial
  Chemically synthesized
agauaccauugcggucac

SEQ ID NO: 4969 - RNA, 18 nt, artificial
  Chemically synthesized
gacuuuaucgcagcucuc

SEQ ID NO: 4970 - RNA, 18 nt, artificial
  Chemically synthesized
ccaccagcuuccaaaguc

SEQ ID NO: 4971 - RNA, 18 nt, artificial
  Chemically synthesized
gcugcacagagaagugac

SEQ ID NO: 4972 - RNA, 18 nt, artificial
  Chemically synthesized
gaaagaaugacacaguca

SEQ ID NO: 4973 - RNA, 18 nt, artificial
  Chemically synthesized
ccuggagguucacacacc

SEQ ID NO: 4974 - RNA, 18 nt, artificial
  Chemically synthesized
ccuguuacacuguguauu

SEQ ID NO: 4975 - RNA, 18 nt, artificial
  Chemically synthesized
cagugucuugggaaugca

SEQ ID NO: 4976 - RNA, 18 nt, artificial
  Chemically synthesized
ucucgcaguuccaaacau

SEQ ID NO: 4977 - RNA, 18 nt, artificial
  Chemically synthesized
caaaucaguaucucgcag

SEQ ID NO: 4978 - RNA, 18 nt, artificial
  Chemically synthesized
cuugcaccacucacucuu

SEQ ID NO: 4979 - RNA, 18 nt, artificial
  Chemically synthesized
cgguuuuuuccaaugaug

SEQ ID NO: 4980 - RNA, 18 nt, artificial
  Chemically synthesized
acgguacauccacguagu

SEQ ID NO: 4981 - RNA, 18 nt, artificial
  Chemically synthesized
ugucugaaugaacuuaac

SEQ ID NO: 4982 - RNA, 18 nt, artificial
  Chemically synthesized
acagguaauuugcuggcc

SEQ ID NO: 4983 - RNA, 18 nt, artificial
  Chemically synthesized
cuuguugcucuugagauc

SEQ ID NO: 4984 - RNA, 18 nt, artificial
  Chemically synthesized
ccacagguaccuucacuu

SEQ ID NO: 4985 - RNA, 18 nt, artificial
  Chemically synthesized
gugacauaaagaucccaa

SEQ ID NO: 4986 - RNA, 18 nt, artificial
  Chemically synthesized
agguucuccacccaguag

SEQ ID NO: 4987 - RNA, 18 nt, artificial
  Chemically synthesized
uugcggcaaauucaaaga

SEQ ID NO: 4988 - RNA, 18 nt, artificial
  Chemically synthesized
cacagucauugagaaucu

SEQ ID NO: 4989 - RNA, 18 nt, artificial
  Chemically synthesized
cagguaccuucacuuggu

SEQ ID NO: 4990 - RNA, 18 nt, artificial
  Chemically synthesized
uguaggugauccuguugu

SEQ ID NO: 4991 - RNA, 18 nt, artificial
  Chemically synthesized
gaaugcagccuguuacac

SEQ ID NO: 4992 - RNA, 18 nt, artificial
  Chemically synthesized
cggacauccugaaccugc

SEQ ID NO: 4993 - RNA, 18 nt, artificial
  Chemically synthesized
cuccugagugaaggagag

SEQ ID NO: 4994 - RNA, 18 nt, artificial
  Chemically synthesized
ccuuggauaccaagggac

SEQ ID NO: 4995 - RNA, 18 nt, artificial
  Chemically synthesized
caaaguuuucagaaagca

SEQ ID NO: 4996 - RNA, 18 nt, artificial
  Chemically synthesized
cagccuguuacacugugu

SEQ ID NO: 4997 - RNA, 18 nt, artificial
  Chemically synthesized
aaacuuucaucggugauu

SEQ ID NO: 4998 - RNA, 18 nt, artificial
  Chemically synthesized
aagcagugaaagagcaau

SEQ ID NO: 4999 - RNA, 18 nt, artificial
  Chemically synthesized
caugccagacaccagugc

SEQ ID NO: 5000 - RNA, 18 nt, artificial
  Chemically synthesized
caguugcuacagauuaca

SEQ ID NO: 5001 - RNA, 18 nt, artificial
  Chemically synthesized
acauuccacggaacuugu

SEQ ID NO: 5002 - RNA, 18 nt, artificial
  Chemically synthesized
uccaugggccacuccagg

SEQ ID NO: 5003 - RNA, 18 nt, artificial
  Chemically synthesized
acauaaagaucccaacua

SEQ ID NO: 5004 - RNA, 18 nt, artificial
  Chemically synthesized
cagcuugcagaagcgcug

SEQ ID NO: 5005 - RNA, 18 nt, artificial
  Chemically synthesized
cacaggccauggaaacgg

SEQ ID NO: 5006 - RNA, 18 nt, artificial
  Chemically synthesized
aagacuuuggccagugcu

SEQ ID NO: 5007 - RNA, 18 nt, artificial
  Chemically synthesized
uccugugacauuccgaca

SEQ ID NO: 5008 - RNA, 18 nt, artificial
  Chemically synthesized
ucaaugggcuccagaaga

SEQ ID NO: 5009 - RNA, 18 nt, artificial
  Chemically synthesized
aauggaaaguguccaaau

SEQ ID NO: 5010 - RNA, 18 nt, artificial
  Chemically synthesized
acccaguaggcaucccgc

SEQ ID NO: 5011 - RNA, 18 nt, artificial
  Chemically synthesized
aagccugauuggaggauu

SEQ ID NO: 5012 - RNA, 18 nt, artificial
  Chemically synthesized
cuaccaguugaaagcagu

SEQ ID NO: 5013 - RNA, 18 nt, artificial
  Chemically synthesized
agcaccagagccuggagg

SEQ ID NO: 5014 - RNA, 18 nt, artificial
  Chemically synthesized
cacucucaggauuugcaa

SEQ ID NO: 5015 - RNA, 18 nt, artificial
  Chemically synthesized
uccuucccgcugagccuc

SEQ ID NO: 5016 - RNA, 18 nt, artificial
  Chemically synthesized
agucucuuagcaggaaga

SEQ ID NO: 5017 - RNA, 18 nt, artificial
  Chemically synthesized
aaaucuccagcaguaaaa

SEQ ID NO: 5018 - RNA, 18 nt, artificial
  Chemically synthesized
acaccauccacaaaguau

SEQ ID NO: 5019 - RNA, 18 nt, artificial
  Chemically synthesized
guccucaaaugacgguac

SEQ ID NO: 5020 - RNA, 18 nt, artificial
  Chemically synthesized
gucaucaacuuauuucug

SEQ ID NO: 5021 - RNA, 18 nt, artificial
  Chemically synthesized
ugccagacaccagugcug

SEQ ID NO: 5022 - RNA, 18 nt, artificial
  Chemically synthesized
gugcuugcugcuccugag

SEQ ID NO: 5023 - RNA, 18 nt, artificial
  Chemically synthesized
uuuucuggccacugacaa

SEQ ID NO: 5024 - RNA, 18 nt, artificial
  Chemically synthesized
ccagcuuccaaagucuuc

SEQ ID NO: 5025 - RNA, 18 nt, artificial
  Chemically synthesized
cccacaccauccacaaag

SEQ ID NO: 5026 - RNA, 18 nt, artificial
  Chemically synthesized
ggucuugguguucauuau

SEQ ID NO: 5027 - RNA, 18 nt, artificial
  Chemically synthesized
uaggucuugguguucauu

SEQ ID NO: 5028 - RNA, 18 nt, artificial
  Chemically synthesized
cuauaggucuccuuugga

SEQ ID NO: 5029 - RNA, 18 nt, artificial
  Chemically synthesized
auguucaagacugcccag

SEQ ID NO: 5030 - RNA, 18 nt, artificial
  Chemically synthesized
cauaagguucuccaccca

SEQ ID NO: 5031 - RNA, 18 nt, artificial
  Chemically synthesized
aggaucagaugacuuaca

SEQ ID NO: 5032 - RNA, 18 nt, artificial
  Chemically synthesized
gauggagagucacacagg

SEQ ID NO: 5033 - RNA, 18 nt, artificial
  Chemically synthesized
aggcuuuuuacagcuucu

SEQ ID NO: 5034 - RNA, 18 nt, artificial
  Chemically synthesized
cucacucuucacaaaguu

SEQ ID NO: 5035 - RNA, 18 nt, artificial
  Chemically synthesized
augagaauggcagcauca

SEQ ID NO: 5036 - RNA, 18 nt, artificial
  Chemically synthesized
uuucccacucucaggauu

SEQ ID NO: 5037 - RNA, 18 nt, artificial
  Chemically synthesized
aaaugggagaaguccagu

SEQ ID NO: 5038 - RNA, 18 nt, artificial
  Chemically synthesized
guucauuugugcuguuuc

SEQ ID NO: 5039 - RNA, 18 nt, artificial
  Chemically synthesized
uucaaacuuuuuggcuca

SEQ ID NO: 5040 - RNA, 18 nt, artificial
  Chemically synthesized
gagucaaugauauuguca

SEQ ID NO: 5041 - RNA, 18 nt, artificial
  Chemically synthesized
gcuugaaccaggaagacg

SEQ ID NO: 5042 - RNA, 18 nt, artificial
  Chemically synthesized
gugaaagagcaaugggca

SEQ ID NO: 5043 - RNA, 18 nt, artificial
  Chemically synthesized
ucaaugauccacuugcca

SEQ ID NO: 5044 - RNA, 18 nt, artificial
  Chemically synthesized
gugacagcuagguaggac

SEQ ID NO: 5045 - RNA, 18 nt, artificial
  Chemically synthesized
caaaugaaguuauugcca

SEQ ID NO: 5046 - RNA, 18 nt, artificial
  Chemically synthesized
agugugugaaaugaguca

SEQ ID NO: 5047 - RNA, 18 nt, artificial
  Chemically synthesized
cagucaccugagagaacg

SEQ ID NO: 5048 - RNA, 18 nt, artificial
  Chemically synthesized
uaggaauagcaacaaguu

SEQ ID NO: 5049 - RNA, 18 nt, artificial
  Chemically synthesized
guuccucaaggaagguaa

SEQ ID NO: 5050 - RNA, 18 nt, artificial
  Chemically synthesized
aaucaagacuuuggccag

SEQ ID NO: 5051 - RNA, 18 nt, artificial
  Chemically synthesized
uguugcuaauguagguga

SEQ ID NO: 5052 - RNA, 18 nt, artificial
  Chemically synthesized
uggguucugcauccauga

SEQ ID NO: 5053 - RNA, 18 nt, artificial
  Chemically synthesized
aggaacagagcacagcac

SEQ ID NO: 5054 - RNA, 18 nt, artificial
  Chemically synthesized
ugaaggaucagaugacuu

SEQ ID NO: 5055 - RNA, 18 nt, artificial
  Chemically synthesized
ugggcuccagaagaauga

SEQ ID NO: 5056 - RNA, 18 nt, artificial
  Chemically synthesized
ucacucuucacaaaguuu

SEQ ID NO: 5057 - RNA, 18 nt, artificial
  Chemically synthesized
cacagguaauuugcuggc

SEQ ID NO: 5058 - RNA, 18 nt, artificial
  Chemically synthesized
agcaaguccucaaaugac

SEQ ID NO: 5059 - RNA, 18 nt, artificial
  Chemically synthesized
cuugccaggaaugaaguc

SEQ ID NO: 5060 - RNA, 18 nt, artificial
  Chemically synthesized
gauguuccugcugggagc

SEQ ID NO: 5061 - RNA, 18 nt, artificial
  Chemically synthesized
gaauagcaacaaguuuug

SEQ ID NO: 5062 - RNA, 18 nt, artificial
  Chemically synthesized
agcaaugggcacaaugag

SEQ ID NO: 5063 - RNA, 18 nt, artificial
  Chemically synthesized
agauuacaguuggcccuc

SEQ ID NO: 5064 - RNA, 18 nt, artificial
  Chemically synthesized
cacaugccagacaccagu

SEQ ID NO: 5065 - RNA, 18 nt, artificial
  Chemically synthesized
ucguccaugggccacucc

SEQ ID NO: 5066 - RNA, 18 nt, artificial
  Chemically synthesized
cacggaacuuguaacauc

SEQ ID NO: 5067 - RNA, 18 nt, artificial
  Chemically synthesized
agcuuuccugggcuuccu

SEQ ID NO: 5068 - RNA, 18 nt, artificial
  Chemically synthesized
cagcuucugugagcccug

SEQ ID NO: 5069 - RNA, 18 nt, artificial
  Chemically synthesized
guaauuugcuggccaauc

SEQ ID NO: 5070 - RNA, 18 nt, artificial
  Chemically synthesized
auccaugaagucaaccaa

SEQ ID NO: 5071 - RNA, 18 nt, artificial
  Chemically synthesized
gaaaguguccaaaucagu

SEQ ID NO: 5072 - RNA, 18 nt, artificial
  Chemically synthesized
cuaggacuuuaucgcagc

SEQ ID NO: 5073 - RNA, 18 nt, artificial
  Chemically synthesized
aauuuugauauccacgag

SEQ ID NO: 5074 - RNA, 18 nt, artificial
  Chemically synthesized
ccauugcggucacaagac

SEQ ID NO: 5075 - RNA, 18 nt, artificial
  Chemically synthesized
caaacauuccacggaacu

SEQ ID NO: 5076 - RNA, 18 nt, artificial
  Chemically synthesized
uggaaaguguccaaauca

SEQ ID NO: 5077 - RNA, 18 nt, artificial
  Chemically synthesized
cacagguaccuucacuug

SEQ ID NO: 5078 - RNA, 18 nt, artificial
  Chemically synthesized
aagauccugagcugcccu

SEQ ID NO: 5079 - RNA, 18 nt, artificial
  Chemically synthesized
cuucacuuggucacuaag

SEQ ID NO: 5080 - RNA, 18 nt, artificial
  Chemically synthesized
auuccacggaacuuguaa

SEQ ID NO: 5081 - RNA, 18 nt, artificial
  Chemically synthesized
acuuuaucgcagcucuca

SEQ ID NO: 5082 - RNA, 18 nt, artificial
  Chemically synthesized
cucuucacaaaguuuuca

SEQ ID NO: 5083 - RNA, 18 nt, artificial
  Chemically synthesized
gagguucacacaccucug

SEQ ID NO: 5084 - RNA, 18 nt, artificial
  Chemically synthesized
aagucccgcuuaugaaga

SEQ ID NO: 5085 - RNA, 18 nt, artificial
  Chemically synthesized
acagagaaugccuuuugu

SEQ ID NO: 5086 - RNA, 18 nt, artificial
  Chemically synthesized
caacaccaaacacuggga

SEQ ID NO: 5087 - RNA, 18 nt, artificial
  Chemically synthesized
uugcggucacaagacaga

SEQ ID NO: 5088 - RNA, 18 nt, artificial
  Chemically synthesized
auggaaacgguggcacag

SEQ ID NO: 5089 - RNA, 18 nt, artificial
  Chemically synthesized
uuuaaagauccugagcug

SEQ ID NO: 5090 - RNA, 18 nt, artificial
  Chemically synthesized
cagcaguaaaauaugcug

SEQ ID NO: 5091 - RNA, 18 nt, artificial
  Chemically synthesized
agacaccagugcuguccu

SEQ ID NO: 5092 - RNA, 18 nt, artificial
  Chemically synthesized
guucuccagcuccuggac

SEQ ID NO: 5093 - RNA, 18 nt, artificial
  Chemically synthesized
agcuccuggaccauaagg

SEQ ID NO: 5094 - RNA, 18 nt, artificial
  Chemically synthesized
ugaauuuguuucaccagu

SEQ ID NO: 5095 - RNA, 18 nt, artificial
  Chemically synthesized
cagagaagugacagcuag

SEQ ID NO: 5096 - RNA, 18 nt, artificial
  Chemically synthesized
uggagguucacacaccuc

SEQ ID NO: 5097 - RNA, 18 nt, artificial
  Chemically synthesized
gcugcccuugcagauacc

SEQ ID NO: 5098 - RNA, 18 nt, artificial
  Chemically synthesized
gcaguuccaaacauucca

SEQ ID NO: 5099 - RNA, 18 nt, artificial
  Chemically synthesized
aguauguggcauugucca

SEQ ID NO: 5100 - RNA, 18 nt, artificial
  Chemically synthesized
ugcuccugagugaaggag

SEQ ID NO: 5101 - RNA, 18 nt, artificial
  Chemically synthesized
acuaagccaguugcuaca

SEQ ID NO: 5102 - RNA, 18 nt, artificial
  Chemically synthesized
agaagugacagcuaggua

SEQ ID NO: 5103 - RNA, 18 nt, artificial
  Chemically synthesized
aacaaaugcaucauagca

SEQ ID NO: 5104 - RNA, 18 nt, artificial
  Chemically synthesized
agaucagcugcacagaga

SEQ ID NO: 5105 - RNA, 18 nt, artificial
  Chemically synthesized
caaccaauucccuuggau

SEQ ID NO: 5106 - RNA, 18 nt, artificial
  Chemically synthesized
ucuuuucaauggagucaa

SEQ ID NO: 5107 - RNA, 18 nt, artificial
  Chemically synthesized
uggccaaucaaucaagac

SEQ ID NO: 5108 - RNA, 18 nt, artificial
  Chemically synthesized
auaugcugcuucauauga

SEQ ID NO: 5109 - RNA, 18 nt, artificial
  Chemically synthesized
caaagucucuccgguuuu

SEQ ID NO: 5110 - RNA, 18 nt, artificial
  Chemically synthesized
ugagccucguccaugggc

SEQ ID NO: 5111 - RNA, 18 nt, artificial
  Chemically synthesized
auaccaagggacuauauu

SEQ ID NO: 5112 - RNA, 18 nt, artificial
  Chemically synthesized
uggaguuuaaagauccug

SEQ ID NO: 5113 - RNA, 18 nt, artificial
  Chemically synthesized
aaccaauucccuuggaua

SEQ ID NO: 5114 - RNA, 18 nt, artificial
  Chemically synthesized
caucccgcucacuguaag

SEQ ID NO: 5115 - RNA, 18 nt, artificial
  Chemically synthesized
uggaaacgguggcacagg

SEQ ID NO: 5116 - RNA, 18 nt, artificial
  Chemically synthesized
gaucagcaggaacagagc

SEQ ID NO: 5117 - RNA, 18 nt, artificial
  Chemically synthesized
ccuugcagauaccauugc

SEQ ID NO: 5118 - RNA, 18 nt, artificial
  Chemically synthesized
acagagaagccugauugg

SEQ ID NO: 5119 - RNA, 18 nt, artificial
  Chemically synthesized
gcuuccaaagucuucagu

SEQ ID NO: 5120 - RNA, 18 nt, artificial
  Chemically synthesized
uuuuggccuggagccagg

SEQ ID NO: 5121 - RNA, 18 nt, artificial
  Chemically synthesized
guuuuguggcucuuuuca

SEQ ID NO: 5122 - RNA, 18 nt, artificial
  Chemically synthesized
ccauggaaacgguggcac

SEQ ID NO: 5123 - RNA, 18 nt, artificial
  Chemically synthesized
cugcgcuuucucgcugcc

SEQ ID NO: 5124 - RNA, 18 nt, artificial
  Chemically synthesized
aggcauccucacaggcug

SEQ ID NO: 5125 - RNA, 18 nt, artificial
  Chemically synthesized
ugcgcuuucucgcugccu

SEQ ID NO: 5126 - RNA, 18 nt, artificial
  Chemically synthesized
auccugaaccugcuggcc

SEQ ID NO: 5127 - RNA, 18 nt, artificial
  Chemically synthesized
gagaggaauucacaggag

SEQ ID NO: 5128 - RNA, 18 nt, artificial
  Chemically synthesized
agcacaugccagacacca

SEQ ID NO: 5129 - RNA, 18 nt, artificial
  Chemically synthesized
caucauuguucucaucaa

SEQ ID NO: 5130 - RNA, 18 nt, artificial
  Chemically synthesized
gaaacgguggcacaggac

SEQ ID NO: 5131 - RNA, 18 nt, artificial
  Chemically synthesized
gcacaugccagacaccag

SEQ ID NO: 5132 - RNA, 18 nt, artificial
  Chemically synthesized
ccgagaggcggacauccu

SEQ ID NO: 5133 - RNA, 18 nt, artificial
  Chemically synthesized
ucauagcagauguuccug

SEQ ID NO: 5134 - RNA, 18 nt, artificial
  Chemically synthesized
auuuguuucaccagugga

SEQ ID NO: 5135 - RNA, 18 nt, artificial
  Chemically synthesized
cgagcagccgccuggcug

SEQ ID NO: 5136 - RNA, 18 nt, artificial
  Chemically synthesized
uuuuguggccacagagga

SEQ ID NO: 5137 - RNA, 18 nt, artificial
  Chemically synthesized
caguucauacuugcacca

SEQ ID NO: 5138 - RNA, 18 nt, artificial
  Chemically synthesized
cagauuacaguuggcccu

SEQ ID NO: 5139 - RNA, 18 nt, artificial
  Chemically synthesized
aaucuccagcaguaaaau

SEQ ID NO: 5140 - RNA, 18 nt, artificial
  Chemically synthesized
gauccugagcugcccuug

SEQ ID NO: 5141 - RNA, 18 nt, artificial
  Chemically synthesized
auaccauugcggucacaa

SEQ ID NO: 5142 - RNA, 18 nt, artificial
  Chemically synthesized
gaauucacaggagcaaau

SEQ ID NO: 5143 - RNA, 18 nt, artificial
  Chemically synthesized
gucaaggcuuuuuacagc

SEQ ID NO: 5144 - RNA, 18 nt, artificial
  Chemically synthesized
ggucaaggcuuuuuacag

SEQ ID NO: 5145 - RNA, 18 nt, artificial
  Chemically synthesized
uucuccacccaguaggca

SEQ ID NO: 5146 - RNA, 18 nt, artificial
  Chemically synthesized
ucucaggauuugcaauuu

SEQ ID NO: 5147 - RNA, 18 nt, artificial
  Chemically synthesized
cuggaucuauaacucugu

SEQ ID NO: 5148 - RNA, 18 nt, artificial
  Chemically synthesized
agguaggucuugguguuc

SEQ ID NO: 5149 - RNA, 18 nt, artificial
  Chemically synthesized
uagcucuguagaucugaa

SEQ ID NO: 5150 - RNA, 18 nt, artificial
  Chemically synthesized
agaaagcacaaagacagu

SEQ ID NO: 5151 - RNA, 18 nt, artificial
  Chemically synthesized
ugcugggagcuuuccugg

SEQ ID NO: 5152 - RNA, 18 nt, artificial
  Chemically synthesized
accaaacacugggagaac

SEQ ID NO: 5153 - RNA, 18 nt, artificial
  Chemically synthesized
gucuucagugugugaaau

SEQ ID NO: 5154 - RNA, 18 nt, artificial
  Chemically synthesized
caauucccuuggauacca

SEQ ID NO: 5155 - RNA, 18 nt, artificial
  Chemically synthesized
gccacugacaaguuucag

SEQ ID NO: 5156 - RNA, 18 nt, artificial
  Chemically synthesized
uuguuaacguuuccacuu

SEQ ID NO: 5157 - RNA, 18 nt, artificial
  Chemically synthesized
ggcuuuuuacagcuucug

SEQ ID NO: 5158 - RNA, 18 nt, artificial
  Chemically synthesized
auuuccagugucuuggga

SEQ ID NO: 5159 - RNA, 18 nt, artificial
  Chemically synthesized
auccagaaaucugauuca

SEQ ID NO: 5160 - RNA, 18 nt, artificial
  Chemically synthesized
aaagucuucaguguguga

SEQ ID NO: 5161 - RNA, 18 nt, artificial
  Chemically synthesized
gaauggcuuuuuucucaa

SEQ ID NO: 5162 - RNA, 18 nt, artificial
  Chemically synthesized
ggugauuuucacauuucu

SEQ ID NO: 5163 - RNA, 18 nt, artificial
  Chemically synthesized
aaugggcuccagaagaau

SEQ ID NO: 5164 - RNA, 18 nt, artificial
  Chemically synthesized
uuucccaguaaguuuaag

SEQ ID NO: 5165 - RNA, 18 nt, artificial
  Chemically synthesized
aaguugcuccuuagaaaa

SEQ ID NO: 5166 - RNA, 18 nt, artificial
  Chemically synthesized
acaccaaacacugggaga

SEQ ID NO: 5167 - RNA, 18 nt, artificial
  Chemically synthesized
cccacagguaccuucacu

SEQ ID NO: 5168 - RNA, 18 nt, artificial
  Chemically synthesized
ugaagucccgcuuaugaa

SEQ ID NO: 5169 - RNA, 18 nt, artificial
  Chemically synthesized
gaaauacacagcacuuuu

SEQ ID NO: 5170 - RNA, 18 nt, artificial
  Chemically synthesized
uguggaucaaaaguaugu

SEQ ID NO: 5171 - RNA, 18 nt, artificial
  Chemically synthesized
uggguaagagggaggcau

SEQ ID NO: 5172 - RNA, 18 nt, artificial
  Chemically synthesized
aggaaugaagucccgcuu

SEQ ID NO: 5173 - RNA, 18 nt, artificial
  Chemically synthesized
agagggccaggcauccuc

SEQ ID NO: 5174 - RNA, 18 nt, artificial
  Chemically synthesized
ugaaagagcaaugggcac

SEQ ID NO: 5175 - RNA, 18 nt, artificial
  Chemically synthesized
caguuuuguggcucuuuu

SEQ ID NO: 5176 - RNA, 18 nt, artificial
  Chemically synthesized
agacagagaagccugauu

SEQ ID NO: 5177 - RNA, 18 nt, artificial
  Chemically synthesized
uaagagcuccugggaguc

SEQ ID NO: 5178 - RNA, 18 nt, artificial
  Chemically synthesized
aguuucauaaccugaaac

SEQ ID NO: 5179 - RNA, 18 nt, artificial
  Chemically synthesized
gaguuuaaagauccugag

SEQ ID NO: 5180 - RNA, 18 nt, artificial
  Chemically synthesized
ccgugagcaggaucagca

SEQ ID NO: 5181 - RNA, 18 nt, artificial
  Chemically synthesized
agaaugagaauggcagca

SEQ ID NO: 5182 - RNA, 18 nt, artificial
  Chemically synthesized
cagaagaaugagaauggc

SEQ ID NO: 5183 - RNA, 18 nt, artificial
  Chemically synthesized
aaagucucuccgguuuuu

SEQ ID NO: 5184 - RNA, 18 nt, artificial
  Chemically synthesized
agucuucagugugugaaa

SEQ ID NO: 5185 - RNA, 18 nt, artificial
  Chemically synthesized
gccaaucaaucaagacuu

SEQ ID NO: 5186 - RNA, 18 nt, artificial
  Chemically synthesized
guguccaaaucaguaucu

SEQ ID NO: 5187 - RNA, 18 nt, artificial
  Chemically synthesized
agaaucuuccucuauugu

SEQ ID NO: 5188 - RNA, 18 nt, artificial
  Chemically synthesized
uuucaccaguggauaguu

SEQ ID NO: 5189 - RNA, 18 nt, artificial
  Chemically synthesized
uuuggauccugcuugcaa

SEQ ID NO: 5190 - RNA, 18 nt, artificial
  Chemically synthesized
ugcauccaugaagucaac

SEQ ID NO: 5191 - RNA, 18 nt, artificial
  Chemically synthesized
uaaguccagcaaaaucuu

SEQ ID NO: 5192 - RNA, 18 nt, artificial
  Chemically synthesized
auauaccacaggccaugg

SEQ ID NO: 5193 - RNA, 18 nt, artificial
  Chemically synthesized
ggcauagaaugaaaacua

SEQ ID NO: 5194 - RNA, 18 nt, artificial
  Chemically synthesized
uuuggccagugcuugcug

SEQ ID NO: 5195 - RNA, 18 nt, artificial
  Chemically synthesized
aaugccuuuuguggccac

SEQ ID NO: 5196 - RNA, 18 nt, artificial
  Chemically synthesized
accacucacucuucacaa

SEQ ID NO: 5197 - RNA, 18 nt, artificial
  Chemically synthesized
aguugcuccuuagaaaac

SEQ ID NO: 5198 - RNA, 18 nt, artificial
  Chemically synthesized
gcugcgcuuucucgcugc

SEQ ID NO: 5199 - RNA, 18 nt, artificial
  Chemically synthesized
gguaccuucacuugguca

SEQ ID NO: 5200 - RNA, 18 nt, artificial
  Chemically synthesized
aagcacaaagacaguuuu

SEQ ID NO: 5201 - RNA, 18 nt, artificial
  Chemically synthesized
gagcacagcacaugccag

SEQ ID NO: 5202 - RNA, 18 nt, artificial
  Chemically synthesized
gccuggcugcgcuuucuc

SEQ ID NO: 5203 - RNA, 18 nt, artificial
  Chemically synthesized
gucaaguuuuucagagug

SEQ ID NO: 5204 - RNA, 18 nt, artificial
  Chemically synthesized
ugugaaaugagucaaguu

SEQ ID NO: 5205 - RNA, 18 nt, artificial
  Chemically synthesized
ccuggcugcgcuuucucg

SEQ ID NO: 5206 - RNA, 18 nt, artificial
  Chemically synthesized
gcaggaacagagcacagc

SEQ ID NO: 5207 - RNA, 18 nt, artificial
  Chemically synthesized
uuggacaggucaaggcuu

SEQ ID NO: 5208 - RNA, 18 nt, artificial
  Chemically synthesized
ggaaaugggagaagucca

SEQ ID NO: 5209 - RNA, 18 nt, artificial
  Chemically synthesized
cuuuccugggcuuccuuu

SEQ ID NO: 5210 - RNA, 18 nt, artificial
  Chemically synthesized
gacaaagacuggucuuaa

SEQ ID NO: 5211 - RNA, 18 nt, artificial
  Chemically synthesized
ggagucacuauaggucuc

SEQ ID NO: 5212 - RNA, 18 nt, artificial
  Chemically synthesized
agucaccugagagaacgc

SEQ ID NO: 5213 - RNA, 18 nt, artificial
  Chemically synthesized
ugagcugcccuugcagau

SEQ ID NO: 5214 - RNA, 18 nt, artificial
  Chemically synthesized
aggagucucuuagcagga

SEQ ID NO: 5215 - RNA, 18 nt, artificial
  Chemically synthesized
ugcagccuguuacacugu

SEQ ID NO: 5216 - RNA, 18 nt, artificial
  Chemically synthesized
cguaguuauugcauuccu

SEQ ID NO: 5217 - RNA, 18 nt, artificial
  Chemically synthesized
cuggucuuaaauauggga

SEQ ID NO: 5218 - RNA, 18 nt, artificial
  Chemically synthesized
ccuuguugcucuugagau

SEQ ID NO: 5219 - RNA, 18 nt, artificial
  Chemically synthesized
gucacuguugcuaaugua

SEQ ID NO: 5220 - RNA, 18 nt, artificial
  Chemically synthesized
auucacaggagcaaauga

SEQ ID NO: 5221 - RNA, 18 nt, artificial
  Chemically synthesized
cugagagaacgccgagca

SEQ ID NO: 5222 - RNA, 18 nt, artificial
  Chemically synthesized
acaaggaaccagaaaaac

SEQ ID NO: 5223 - RNA, 18 nt, artificial
  Chemically synthesized
uuccaaacauuccacgga

SEQ ID NO: 5224 - RNA, 18 nt, artificial
  Chemically synthesized
aucuuuucuggccacuga

SEQ ID NO: 5225 - RNA, 18 nt, artificial
  Chemically synthesized
gaggauccugcaaccaau

SEQ ID NO: 5226 - RNA, 18 nt, artificial
  Chemically synthesized
cagucauugagaaucuua

SEQ ID NO: 5227 - RNA, 18 nt, artificial
  Chemically synthesized
gcuuucucgcugccuccg

SEQ ID NO: 5228 - RNA, 18 nt, artificial
  Chemically synthesized
gcacaaagacaguuuugu

SEQ ID NO: 5229 - RNA, 18 nt, artificial
  Chemically synthesized
guaucucgcaguuccaaa

SEQ ID NO: 5230 - RNA, 18 nt, artificial
  Chemically synthesized
aaucaguaucucgcaguu

SEQ ID NO: 5231 - RNA, 18 nt, artificial
  Chemically synthesized
acacaccucuguagguca

SEQ ID NO: 5232 - RNA, 18 nt, artificial
  Chemically synthesized
agcacaaagacaguuuug

SEQ ID NO: 5233 - RNA, 18 nt, artificial
  Chemically synthesized
acucacucuucacaaagu

SEQ ID NO: 5234 - RNA, 18 nt, artificial
  Chemically synthesized
uugggaaugcagccuguu

SEQ ID NO: 5235 - RNA, 18 nt, artificial
  Chemically synthesized
cagcacaugccagacacc

SEQ ID NO: 5236 - RNA, 18 nt, artificial
  Chemically synthesized
ggccauggaaacgguggc

SEQ ID NO: 5237 - RNA, 18 nt, artificial
  Chemically synthesized
ucaaccaacuguggauca

SEQ ID NO: 5238 - RNA, 18 nt, artificial
  Chemically synthesized
gcagcuugcagaagcgcu

SEQ ID NO: 5239 - RNA, 18 nt, artificial
  Chemically synthesized
cucuuucuguaagugaau

SEQ ID NO: 5240 - RNA, 18 nt, artificial
  Chemically synthesized
acaaagacuggucuuaaa

SEQ ID NO: 5241 - RNA, 18 nt, artificial
  Chemically synthesized
gggaauggaguuuaaaga

SEQ ID NO: 5242 - RNA, 18 nt, artificial
  Chemically synthesized
acuaagagcuccugggag

SEQ ID NO: 5243 - RNA, 18 nt, artificial
  Chemically synthesized
ccuggaucuauaacucug

SEQ ID NO: 5244 - RNA, 18 nt, artificial
  Chemically synthesized
cacagcacuuuuuucuag

SEQ ID NO: 5245 - RNA, 18 nt, artificial
  Chemically synthesized
aguccucaaaugacggua

SEQ ID NO: 5246 - RNA, 18 nt, artificial
  Chemically synthesized
uucgugugcuggauaagu

SEQ ID NO: 5247 - RNA, 18 nt, artificial
  Chemically synthesized
ugauccuguuguuggaca

SEQ ID NO: 5248 - RNA, 18 nt, artificial
  Chemically synthesized
caccacucacucuucaca

SEQ ID NO: 5249 - RNA, 18 nt, artificial
  Chemically synthesized
cccucuauauccaugggu

SEQ ID NO: 5250 - RNA, 18 nt, artificial
  Chemically synthesized
auguaggugauccuguug

SEQ ID NO: 5251 - RNA, 18 nt, artificial
  Chemically synthesized
ccuuuuguggccacagag

SEQ ID NO: 5252 - RNA, 18 nt, Artificial Sequence
  Chemically synthesized
augaagucccgcuuauga

SEQ ID NO: 5253 - RNA, 18 nt, artificial
  Chemically synthesized
ugaacaccaagaccuacc

SEQ ID NO: 5254 - RNA, 18 nt, artificial
  Chemically synthesized
gccucccucuuacccaug

SEQ ID NO: 5255 - RNA, 18 nt, artificial
  Chemically synthesized
agaaaagauuuugcugga

SEQ ID NO: 5256 - RNA, 18 nt, artificial
  Chemically synthesized
ugcaagggcagcucagga

SEQ ID NO: 5257 - RNA, 18 nt, artificial
  Chemically synthesized
gacuccauugaaaagagc

SEQ ID NO: 5258 - RNA, 18 nt, artificial
  Chemically synthesized
caguagaaaacaguaaag

SEQ ID NO: 5259 - RNA, 18 nt, artificial
  Chemically synthesized
ugaacuggacuucuccca

SEQ ID NO: 5260 - RNA, 18 nt, artificial
  Chemically synthesized
auccuucauaugaagcag

SEQ ID NO: 5261 - RNA, 18 nt, artificial
  Chemically synthesized
cuccaggccaaaaggaag

SEQ ID NO: 5262 - RNA, 18 nt, artificial
  Chemically synthesized
uggcccucucuacaaacu

SEQ ID NO: 5263 - RNA, 18 nt, artificial
  Chemically synthesized
agauucuuuuucuucccu

SEQ ID NO: 5264 - RNA, 18 nt, artificial
  Chemically synthesized
auaacuucauuugcuccu

SEQ ID NO: 5265 - RNA, 18 nt, artificial
  Chemically synthesized
guaaaguuuuucugguuc

SEQ ID NO: 5266 - RNA, 18 nt, artificial
  Chemically synthesized
aagacuuuggaagcuggu

SEQ ID NO: 5267 - RNA, 18 nt, artificial
  Chemically synthesized
agcagcauauuuuacugc

SEQ ID NO: 5268 - RNA, 18 nt, artificial
  Chemically synthesized
aaguugaugacucuacca

SEQ ID NO: 5269 - RNA, 18 nt, artificial
  Chemically synthesized
aaaucaccgaugaaaguu

SEQ ID NO: 5270 - RNA, 18 nt, artificial
  Chemically synthesized
agcccaggaaagcuccca

SEQ ID NO: 5271 - RNA, 18 nt, artificial
  Chemically synthesized
ugacucuaccagaugccu

SEQ ID NO: 5272 - RNA, 18 nt, artificial
  Chemically synthesized
ucucaucucacaaaauug

SEQ ID NO: 5273 - RNA, 18 nt, artificial
  Chemically synthesized
aaguuccguggaauguuu

SEQ ID NO: 5274 - RNA, 18 nt, artificial
  Chemically synthesized
augaacaccaagaccuac

SEQ ID NO: 5275 - RNA, 18 nt, artificial
  Chemically synthesized
gucuucauaagcgggacu

SEQ ID NO: 5276 - RNA, 18 nt, artificial
  Chemically synthesized
ucccauuuccgucuuuuu

SEQ ID NO: 5277 - RNA, 18 nt, artificial
  Chemically synthesized
uuucugguuccuuguuua

SEQ ID NO: 5278 - RNA, 18 nt, artificial
  Chemically synthesized
ugacuccauugaaaagag

SEQ ID NO: 5279 - RNA, 18 nt, artificial
  Chemically synthesized
uauggacaccuucacuaa

SEQ ID NO: 5280 - RNA, 18 nt, artificial
  Chemically synthesized
cugugugacucuccaucc

SEQ ID NO: 5281 - RNA, 18 nt, artificial
  Chemically synthesized
aacacaauagaggaagau

SEQ ID NO: 5282 - RNA, 18 nt, artificial
  Chemically synthesized
cucuccaaggaagaaucc

SEQ ID NO: 5283 - RNA, 18 nt, artificial
  Chemically synthesized
aaguugugucuucauaag

SEQ ID NO: 5284 - RNA, 18 nt, artificial
  Chemically synthesized
aacuucauuugcuccugu

SEQ ID NO: 5285 - RNA, 18 nt, artificial
  Chemically synthesized
uugaugacucuaccagau

SEQ ID NO: 5286 - RNA, 18 nt, artificial
  Chemically synthesized
ucuuacagugagcgggau

SEQ ID NO: 5287 - RNA, 18 nt, artificial
  Chemically synthesized
accugugugacucuccau

SEQ ID NO: 5288 - RNA, 18 nt, artificial
  Chemically synthesized
cuaccuggaguggcccau

SEQ ID NO: 5289 - RNA, 18 nt, artificial
  Chemically synthesized
aaucacaguagaaaacag

SEQ ID NO: 5290 - RNA, 18 nt, artificial
  Chemically synthesized
aucaggcuucucugucuu

SEQ ID NO: 5291 - RNA, 18 nt, artificial
  Chemically synthesized
gcucaggaucuuuaaacu

SEQ ID NO: 5292 - RNA, 18 nt, artificial
  Chemically synthesized
ccagcgcuucugcaagcu

SEQ ID NO: 5293 - RNA, 18 nt, artificial
  Chemically synthesized
aacuuacugggaaauccu

SEQ ID NO: 5294 - RNA, 18 nt, artificial
  Chemically synthesized
aaagagccacaaaacugu

SEQ ID NO: 5295 - RNA, 18 nt, artificial
  Chemically synthesized
uugaaaaauucagccugu

SEQ ID NO: 5296 - RNA, 18 nt, artificial
  Chemically synthesized
auuagcaacagugaccua

SEQ ID NO: 5297 - RNA, 18 nt, artificial
  Chemically synthesized
aacugucuuugugcuuuc

SEQ ID NO: 5298 - RNA, 18 nt, artificial
  Chemically synthesized
ucuggcaugugcugugcu

SEQ ID NO: 5299 - RNA, 18 nt, artificial
  Chemically synthesized
caagcacuggccaaaguc

SEQ ID NO: 5300 - RNA, 18 nt, artificial
  Chemically synthesized
aacaccaagaccuaccug

SEQ ID NO: 5301 - RNA, 18 nt, artificial
  Chemically synthesized
caggaucaccuacauuag

SEQ ID NO: 5302 - RNA, 18 nt, artificial
  Chemically synthesized
uucagaauguaagucauc

SEQ ID NO: 5303 - RNA, 18 nt, artificial
  Chemically synthesized
cuccaucccaugugcgug

SEQ ID NO: 5304 - RNA, 18 nt, artificial
  Chemically synthesized
augacuguacccuuaaug

SEQ ID NO: 5305 - RNA, 18 nt, artificial
  Chemically synthesized
ucucccauuuccgucuuu

SEQ ID NO: 5306 - RNA, 18 nt, artificial
  Chemically synthesized
guccaacaacaggaucac

SEQ ID NO: 5307 - RNA, 18 nt, artificial
  Chemically synthesized
aaacuuacugggaaaucc

SEQ ID NO: 5308 - RNA, 18 nt, artificial
  Chemically synthesized
gcaagcacuggccaaagu

SEQ ID NO: 5309 - RNA, 18 nt, artificial
  Chemically synthesized
uuaacaauccggaggcug

SEQ ID NO: 5310 - RNA, 18 nt, artificial
  Chemically synthesized
aauguaagucaucugauc

SEQ ID NO: 5311 - RNA, 18 nt, artificial
  Chemically synthesized
ugcucuguuccugcugau

SEQ ID NO: 5312 - RNA, 18 nt, artificial
  Chemically synthesized
aagggcagcucaggaucu

SEQ ID NO: 5313 - RNA, 18 nt, artificial
  Chemically synthesized
cuuuuucuucccugggca

SEQ ID NO: 5314 - RNA, 18 nt, artificial
  Chemically synthesized
gaaaagauuuugcuggac

SEQ ID NO: 5315 - RNA, 18 nt, artificial
  Chemically synthesized
aaguaugaacuggacuuc

SEQ ID NO: 5316 - RNA, 18 nt, artificial
  Chemically synthesized
auccagcacacgaauaca

SEQ ID NO: 5317 - RNA, 18 nt, artificial
  Chemically synthesized
cacauacuuuguggaugg

SEQ ID NO: 5318 - RNA, 18 nt, artificial
  Chemically synthesized
cauuuccgucuuuuugau

SEQ ID NO: 5319 - RNA, 18 nt, artificial
  Chemically synthesized
cuuaccuuccuugaggaa

SEQ ID NO: 5320 - RNA, 18 nt, artificial
  Chemically synthesized
acuucucccauuuccguc

SEQ ID NO: 5321 - RNA, 18 nt, artificial
  Chemically synthesized
ccuguccaacaacaggau

SEQ ID NO: 5322 - RNA, 18 nt, artificial
  Chemically synthesized
guuauagauccagguaaa

SEQ ID NO: 5323 - RNA, 18 nt, artificial
  Chemically synthesized
uccugcugauccugcuca

SEQ ID NO: 5324 - RNA, 18 nt, artificial
  Chemically synthesized
uauagauccagguaaagu

SEQ ID NO: 5325 - RNA, 18 nt, artificial
  Chemically synthesized
ggaugccuacugggugga

SEQ ID NO: 5326 - RNA, 18 nt, artificial
  Chemically synthesized
aucccaugugcguggcca

SEQ ID NO: 5327 - RNA, 18 nt, artificial
  Chemically synthesized
agccugugaggaugccug

SEQ ID NO: 5328 - RNA, 18 nt, artificial
  Chemically synthesized
uccuccaaucaggcuucu

SEQ ID NO: 5329 - RNA, 18 nt, artificial
  Chemically synthesized
ugugacucuccaucccau

SEQ ID NO: 5330 - RNA, 18 nt, artificial
  Chemically synthesized
uuucagaacuauccacug

SEQ ID NO: 5331 - RNA, 18 nt, artificial
  Chemically synthesized
aaccuuaugguccaggag

SEQ ID NO: 5332 - RNA, 18 nt, artificial
  Chemically synthesized
aaauauggacaccuucac

SEQ ID NO: 5333 - RNA, 18 nt, artificial
  Chemically synthesized
cagcacacgaauacacag

SEQ ID NO: 5334 - RNA, 18 nt, artificial
  Chemically synthesized
cugauccuucauaugaag

SEQ ID NO: 5335 - RNA, 18 nt, artificial
  Chemically synthesized
uguuucuuacagugagcg

SEQ ID NO: 5336 - RNA, 18 nt, artificial
  Chemically synthesized
accuguccaacaacagga

SEQ ID NO: 5337 - RNA, 18 nt, artificial
  Chemically synthesized
gauuuugcuggacuuacc

SEQ ID NO: 5338 - RNA, 18 nt, artificial
  Chemically synthesized
uggugcugacauccaaug

SEQ ID NO: 5339 - RNA, 18 nt, artificial
  Chemically synthesized
uccuggcaaguggaucau

SEQ ID NO: 5340 - RNA, 18 nt, artificial
  Chemically synthesized
cuaccagaugccucccuc

SEQ ID NO: 5341 - RNA, 18 nt, artificial
  Chemically synthesized
ugcaaguaugaacuggac

SEQ ID NO: 5342 - RNA, 18 nt, artificial
  Chemically synthesized
aucagauuucuggauugu

SEQ ID NO: 5343 - RNA, 18 nt, artificial
  Chemically synthesized
cuggcuccaggccaaaag

SEQ ID NO: 5344 - RNA, 18 nt, artificial
  Chemically synthesized
auugauuggccagcaaau

SEQ ID NO: 5345 - RNA, 18 nt, artificial
  Chemically synthesized
auguaagucaucugaucc

SEQ ID NO: 5346 - RNA, 18 nt, artificial
  Chemically synthesized
cucuccaucccaugugcg

SEQ ID NO: 5347 - RNA, 18 nt, artificial
  Chemically synthesized
uauuuuacugcuggagau

SEQ ID NO: 5348 - RNA, 18 nt, artificial
  Chemically synthesized
cuucugcaagcugcggaa

SEQ ID NO: 5349 - RNA, 18 nt, artificial
  Chemically synthesized
gagaaccuuaugguccag

SEQ ID NO: 5350 - RNA, 18 nt, artificial
  Chemically synthesized
uaaacuuacugggaaauc

SEQ ID NO: 5351 - RNA, 18 nt, artificial
  Chemically synthesized
gugacucuccaucccaug

SEQ ID NO: 5352 - RNA, 18 nt, artificial
  Chemically synthesized
ugcugugcucuguuccug

SEQ ID NO: 5353 - RNA, 18 nt, artificial
  Chemically synthesized
auaagcgggacuucauuc

SEQ ID NO: 5354 - RNA, 18 nt, artificial
  Chemically synthesized
aaaugugaaaaucaccga

SEQ ID NO: 5355 - RNA, 18 nt, artificial
  Chemically synthesized
aaauuaccugugugacuc

SEQ ID NO: 5356 - RNA, 18 nt, artificial
  Chemically synthesized
uucuuacagugagcggga

SEQ ID NO: 5357 - RNA, 18 nt, artificial
  Chemically synthesized
acaaugaugcugccauuc

SEQ ID NO: 5358 - RNA, 18 nt, artificial
  Chemically synthesized
aucaucagccucuccaag

SEQ ID NO: 5359 - RNA, 18 nt, artificial
  Chemically synthesized
aaauucagccugugagga

SEQ ID NO: 5360 - RNA, 18 nt, artificial
  Chemically synthesized
acauuagcaacagugacc

SEQ ID NO: 5361 - RNA, 18 nt, artificial
  Chemically synthesized
agaauccuccaaucaggc

SEQ ID NO: 5362 - RNA, 18 nt, artificial
  Chemically synthesized
gauggugugggucuuggg

SEQ ID NO: 5363 - RNA, 18 nt, artificial
  Chemically synthesized
uuuccgucuuuuugauga

SEQ ID NO: 5364 - RNA, 18 nt, artificial
  Chemically synthesized
aauuugccgcaacucaaa

SEQ ID NO: 5365 - RNA, 18 nt, artificial
  Chemically synthesized
ugaacuuauccagcacac

SEQ ID NO: 5366 - RNA, 18 nt, artificial
  Chemically synthesized
uccaaucaggcuucucug

SEQ ID NO: 5367 - RNA, 18 nt, artificial
  Chemically synthesized
aaugugaaaaucaccgau

SEQ ID NO: 5368 - RNA, 18 nt, artificial
  Chemically synthesized
cccagcgcuucugcaagc

SEQ ID NO: 5369 - RNA, 18 nt, artificial
  Chemically synthesized
agcaagcacuggccaaag

SEQ ID NO: 5370 - RNA, 18 nt, artificial
  Chemically synthesized
ugugcugugcucuguucc

SEQ ID NO: 5371 - RNA, 18 nt, artificial
  Chemically synthesized
aacaaugaugcugccauu

SEQ ID NO: 5372 - RNA, 18 nt, artificial
  Chemically synthesized
ucauuccuggcaagugga

SEQ ID NO: 5373 - RNA, 18 nt, artificial
  Chemically synthesized
aauuaccugugugacucu

SEQ ID NO: 5374 - RNA, 18 nt, artificial
  Chemically synthesized
aguuugaugacuguaccc

SEQ ID NO: 5375 - RNA, 18 nt, artificial
  Chemically synthesized
uuuucagaacuauccacu

SEQ ID NO: 5376 - RNA, 18 nt, artificial
  Chemically synthesized
ucccucuuacccauguua

SEQ ID NO: 5377 - RNA, 18 nt, artificial
  Chemically synthesized
uggccagcaaauuaccug

SEQ ID NO: 5378 - RNA, 18 nt, artificial
  Chemically synthesized
caucucuuuuuucucauc

SEQ ID NO: 5379 - RNA, 18 nt, artificial
  Chemically synthesized
cagaugccucccucuuac

SEQ ID NO: 5380 - RNA, 18 nt, artificial
  Chemically synthesized
ugaagcagcauauuuuac

SEQ ID NO: 5381 - RNA, 18 nt, artificial
  Chemically synthesized
uaccugugugacucucca

SEQ ID NO: 5382 - RNA, 18 nt, artificial
  Chemically synthesized
uuuacugcuggagauuuu

SEQ ID NO: 5383 - RNA, 18 nt, artificial
  Chemically synthesized
uucaggauguccgccucu

SEQ ID NO: 5384 - RNA, 18 nt, artificial
  Chemically synthesized
uucacucaggagcagcaa

SEQ ID NO: 5385 - RNA, 18 nt, artificial
  Chemically synthesized
auccagguaaaguggaaa

SEQ ID NO: 5386 - RNA, 18 nt, artificial
  Chemically synthesized
gucuggcaugugcugugc

SEQ ID NO: 5387 - RNA, 18 nt, artificial
  Chemically synthesized
aucuuuaaacuccauucc

SEQ ID NO: 5388 - RNA, 18 nt, artificial
  Chemically synthesized
uggauggugugggucuug

SEQ ID NO: 5389 - RNA, 18 nt, artificial
  Chemically synthesized
cugugcucuguuccugcu

SEQ ID NO: 5390 - RNA, 18 nt, artificial
  Chemically synthesized
aauccggaggcugcauau

SEQ ID NO: 5391 - RNA, 18 nt, artificial
  Chemically synthesized
gugagcgggaugccuacu

SEQ ID NO: 5392 - RNA, 18 nt, artificial
  Chemically synthesized
uuacugcuggagauuuuu

SEQ ID NO: 5393 - RNA, 18 nt, artificial
  Chemically synthesized
uucagaacuauccacugg

SEQ ID NO: 5394 - RNA, 18 nt, artificial
  Chemically synthesized
ugaccuguccaacaacag

SEQ ID NO: 5395 - RNA, 18 nt, artificial
  Chemically synthesized
guuccugcugauccugcu

SEQ ID NO: 5396 - RNA, 18 nt, artificial
  Chemically synthesized
ccuaccuggaguggccca

SEQ ID NO: 5397 - RNA, 18 nt, artificial
  Chemically synthesized
uugaacuuauccagcaca

SEQ ID NO: 5398 - RNA, 18 nt, artificial
  Chemically synthesized
aggaucuuuaaacuccau

SEQ ID NO: 5399 - RNA, 18 nt, artificial
  Chemically synthesized
auacacaguguaacaggc

SEQ ID NO: 5400 - RNA, 18 nt, artificial
  Chemically synthesized
uaccuuccuugaggaacu

SEQ ID NO: 5401 - RNA, 18 nt, artificial
  Chemically synthesized
ugccacauacuuugugga

SEQ ID NO: 5402 - RNA, 18 nt, artificial
  Chemically synthesized
ucaggagcagcaagcacu

SEQ ID NO: 5403 - RNA, 18 nt, artificial
  Chemically synthesized
uugugcuuucugaaaacu

SEQ ID NO: 5404 - RNA, 18 nt, artificial
  Chemically synthesized
cuuaugguccaggagcug

SEQ ID NO: 5405 - RNA, 18 nt, artificial
  Chemically synthesized
guucaggauguccgccuc

SEQ ID NO: 5406 - RNA, 18 nt, artificial
  Chemically synthesized
ucaggauguccgccucuc

SEQ ID NO: 5407 - RNA, 18 nt, artificial
  Chemically synthesized
uuugcuggacuuaccuuc

SEQ ID NO: 5408 - RNA, 18 nt, artificial
  Chemically synthesized
gaaauccuuacaaaaccc

SEQ ID NO: 5409 - RNA, 18 nt, artificial
  Chemically synthesized
uugugucuucauaagcgg

SEQ ID NO: 5410 - RNA, 18 nt, artificial
  Chemically synthesized
acaguaaaguuuuucugg

SEQ ID NO: 5411 - RNA, 18 nt, artificial
  Chemically synthesized
caagaccuaccuggagug

SEQ ID NO: 5412 - RNA, 18 nt, artificial
  Chemically synthesized
ugucuucauaagcgggac

SEQ ID NO: 5413 - RNA, 18 nt, artificial
  Chemically synthesized
uuauccagcacacgaaua

SEQ ID NO: 5414 - RNA, 18 nt, artificial
  Chemically synthesized
aucuacagagcuaugagc

SEQ ID NO: 5415 - RNA, 18 nt, artificial
  Chemically synthesized
ucuccaucccaugugcgu

SEQ ID NO: 5416 - RNA, 18 nt, artificial
  Chemically synthesized
ucuuacccauguuacuag

SEQ ID NO: 5417 - RNA, 18 nt, artificial
  Chemically synthesized
uuuugcuggacuuaccuu

SEQ ID NO: 5418 - RNA, 18 nt, artificial
  Chemically synthesized
uugccgcaacucaaagaa

SEQ ID NO: 5419 - RNA, 18 nt, artificial
  Chemically synthesized
uucucccauuuccgucuu

SEQ ID NO: 5420 - RNA, 18 nt, artificial
  Chemically synthesized
ugucuggcaugugcugug

SEQ ID NO: 5421 - RNA, 18 nt, artificial
  Chemically synthesized
ucuaaggagcaacuugac

SEQ ID NO: 5422 - RNA, 18 nt, artificial
  Chemically synthesized
ugaaaaugaugugggccu

SEQ ID NO: 5423 - RNA, 18 nt, artificial
  Chemically synthesized
uuggguaaaucugagagc

SEQ ID NO: 5424 - RNA, 18 nt, artificial
  Chemically synthesized
ucuaccagaugccucccu

SEQ ID NO: 5425 - RNA, 18 nt, artificial
  Chemically synthesized
aaggaagcccaggaaagc

SEQ ID NO: 5426 - RNA, 18 nt, artificial
  Chemically synthesized
uacugcuggagauuuuug

SEQ ID NO: 5427 - RNA, 18 nt, artificial
  Chemically synthesized
uguuccugcugauccugc

SEQ ID NO: 5428 - RNA, 18 nt, artificial
  Chemically synthesized
accuuccuugaggaacuu

SEQ ID NO: 5429 - RNA, 18 nt, artificial
  Chemically synthesized
aagaauccuccaaucagg

SEQ ID NO: 5430 - RNA, 18 nt, artificial
  Chemically synthesized
acucaggagcagcaagca

SEQ ID NO: 5431 - RNA, 18 nt, artificial
  Chemically synthesized
ugacucuccaucccaugu

SEQ ID NO: 5432 - RNA, 18 nt, artificial
  Chemically synthesized
aagcugguggcaauaacu

SEQ ID NO: 5433 - RNA, 18 nt, artificial
  Chemically synthesized
agguucaggauguccgcc

SEQ ID NO: 5434 - RNA, 18 nt, artificial
  Chemically synthesized
aaaaagccuugaccuguc

SEQ ID NO: 5435 - RNA, 18 nt, artificial
  Chemically synthesized
uuggaacugcgagauacu

SEQ ID NO: 5436 - RNA, 18 nt, artificial
  Chemically synthesized
uguaacaggcugcauucc

SEQ ID NO: 5437 - RNA, 18 nt, artificial
  Chemically synthesized
aacagugaccuacagagg

SEQ ID NO: 5438 - RNA, 18 nt, artificial
  Chemically synthesized
auucagccugugaggaug

SEQ ID NO: 5439 - RNA, 18 nt, artificial
  Chemically synthesized
acauacuuuguggauggu

SEQ ID NO: 5440 - RNA, 18 nt, artificial
  Chemically synthesized
ugccucccucuuacccau

SEQ ID NO: 5441 - RNA, 18 nt, artificial
  Chemically synthesized
aucaccgaugaaaguuug

SEQ ID NO: 5442 - RNA, 18 nt, artificial
  Chemically synthesized
gcgcuucugcaagcugcg

SEQ ID NO: 5443 - RNA, 18 nt, artificial
  Chemically synthesized
ucaggcuucucugucuug

SEQ ID NO: 5444 - RNA, 18 nt, artificial
  Chemically synthesized
gagcgggaugccuacugg

SEQ ID NO: 5445 - RNA, 18 nt, artificial
  Chemically synthesized
augugcugugcucuguuc

SEQ ID NO: 5446 - RNA, 18 nt, artificial
  Chemically synthesized
uaacuucauuugcuccug

SEQ ID NO: 5447 - RNA, 18 nt, artificial
  Chemically synthesized
uuugcuccugugaauucc

SEQ ID NO: 5448 - RNA, 18 nt, artificial
  Chemically synthesized
gaagcccaggaaagcucc

SEQ ID NO: 5449 - RNA, 18 nt, artificial
  Chemically synthesized
uguacccuuaauggaguu

SEQ ID NO: 5450 - RNA, 18 nt, artificial
  Chemically synthesized
uugcuccugugaauuccu

SEQ ID NO: 5451 - RNA, 18 nt, artificial
  Chemically synthesized
uaugaacuggacuucucc

SEQ ID NO: 5452 - RNA, 18 nt, artificial
  Chemically synthesized
uuguggaugguguggguc

SEQ ID NO: 5453 - RNA, 18 nt, artificial
  Chemically synthesized
cuucucugucuugugacc

SEQ ID NO: 5454 - RNA, 18 nt, artificial
  Chemically synthesized
auuuugcuggacuuaccu

SEQ ID NO: 5455 - RNA, 18 nt, artificial
  Chemically synthesized
auagauccagguaaagug

SEQ ID NO: 5456 - RNA, 18 nt, artificial
  Chemically synthesized
uaccagaugccucccucu

SEQ ID NO: 5457 - RNA, 18 nt, artificial
  Chemically synthesized
gaccuaccuggaguggcc

SEQ ID NO: 5458 - RNA, 18 nt, artificial
  Chemically synthesized
uaugccugaaacuuguca

SEQ ID NO: 5459 - RNA, 18 nt, artificial
  Chemically synthesized
cuguuccugcugauccug

SEQ ID NO: 5460 - RNA, 18 nt, artificial
  Chemically synthesized
gaugugggccuggcucca

SEQ ID NO: 5461 - RNA, 18 nt, artificial
  Chemically synthesized
uacaaguuccguggaaug

SEQ ID NO: 5462 - RNA, 18 nt, artificial
  Chemically synthesized
gccugugaggaugccugg

SEQ ID NO: 5463 - RNA, 18 nt, artificial
  Chemically synthesized
auccuccaaucaggcuuc

SEQ ID NO: 5464 - RNA, 18 nt, artificial
  Chemically synthesized
uacuugaaaaauucagcc

SEQ ID NO: 5465 - RNA, 18 nt, artificial
  Chemically synthesized
cugugaggaugccuggcc

SEQ ID NO: 5466 - RNA, 18 nt, artificial
  Chemically synthesized
ccaucccaugugcguggc

SEQ ID NO: 5467 - RNA, 18 nt, artificial
  Chemically synthesized
aacaauccggaggcugca

SEQ ID NO: 5468 - RNA, 18 nt, artificial
  Chemically synthesized
uucugguuccuuguuuac

SEQ ID NO: 5469 - RNA, 18 nt, artificial
  Chemically synthesized
agcgggaugccuacuggg

SEQ ID NO: 5470 - RNA, 18 nt, artificial
  Chemically synthesized
auuaccugugugacucuc

SEQ ID NO: 5471 - RNA, 18 nt, artificial
  Chemically synthesized
aagagccacaaaacuguc

SEQ ID NO: 5472 - RNA, 18 nt, artificial
  Chemically synthesized
uaaaucugagagcugcga

SEQ ID NO: 5473 - RNA, 18 nt, artificial
  Chemically synthesized
uuuggguaaaucugagag

SEQ ID NO: 5474 - RNA, 18 nt, artificial
  Chemically synthesized
aaugccacauacuuugug

SEQ ID NO: 5475 - RNA, 18 nt, artificial
  Chemically synthesized
uaacacaauagaggaaga

SEQ ID NO: 5476 - RNA, 18 nt, artificial
  Chemically synthesized
ugagcgggaugccuacug

SEQ ID NO: 5477 - RNA, 18 nt, artificial
  Chemically synthesized
uugaccuguccaacaaca

SEQ ID NO: 5478 - RNA, 18 nt, artificial
  Chemically synthesized
augaugugggccuggcuc

SEQ ID NO: 5479 - RNA, 18 nt, artificial
  Chemically synthesized
ccaggccaaaaggaagcc

SEQ ID NO: 5480 - RNA, 18 nt, artificial
  Chemically synthesized
uuugugcuuucugaaaac

SEQ ID NO: 5481 - RNA, 18 nt, artificial
  Chemically synthesized
aaaaucaccgaugaaagu

SEQ ID NO: 5482 - RNA, 18 nt, artificial
  Chemically synthesized
uaaacuccauucccucag

SEQ ID NO: 5483 - RNA, 18 nt, artificial
  Chemically synthesized
ucaccgaugaaaguuugu

SEQ ID NO: 5484 - RNA, 18 nt, artificial
  Chemically synthesized
uuugaauuugccgcaacu

SEQ ID NO: 5485 - RNA, 18 nt, artificial
  Chemically synthesized
ucacucaggagcagcaag

SEQ ID NO: 5486 - RNA, 18 nt, artificial
  Chemically synthesized
aagaccuaccuggagugg

SEQ ID NO: 5487 - RNA, 18 nt, artificial
  Chemically synthesized
cucuaccagaugccuccc

SEQ ID NO: 5488 - RNA, 18 nt, artificial
  Chemically synthesized
agugagcgggaugccuac

SEQ ID NO: 5489 - RNA, 18 nt, artificial
  Chemically synthesized
acuuuguggauggugugg

SEQ ID NO: 5490 - RNA, 18 nt, artificial
  Chemically synthesized
ccugugaggaugccuggc

SEQ ID NO: 5491 - RNA, 18 nt, artificial
  Chemically synthesized
augacucuaccagaugcc

SEQ ID NO: 5492 - RNA, 18 nt, artificial
  Chemically synthesized
uaagcgggacuucauucc

SEQ ID NO: 5493 - RNA, 18 nt, artificial
  Chemically synthesized
uaccuggaguggcccaug

SEQ ID NO: 5494 - RNA, 18 nt, artificial
  Chemically synthesized
uuuuggguaaaucugaga

SEQ ID NO: 5495 - RNA, 18 nt, artificial
  Chemically synthesized
aggagcagcaagcacugg

SEQ ID NO: 5496 - RNA, 18 nt, artificial
  Chemically synthesized
acucuaccagaugccucc

SEQ ID NO: 5497 - RNA, 18 nt, artificial
  Chemically synthesized
uuccuggcaaguggauca

SEQ ID NO: 5498 - RNA, 18 nt, artificial
  Chemically synthesized
uacuuuguggauggugug

SEQ ID NO: 5499 - RNA, 18 nt, artificial
  Chemically synthesized
caggagcagcaagcacug

SEQ ID NO: 5500 - RNA, 18 nt, artificial
  Chemically synthesized
uaugguccaggagcugga

SEQ ID NO: 5501 - RNA, 18 nt, artificial
  Chemically synthesized
aaaguuuuucugguuccu

SEQ ID NO: 5502 - RNA, 18 nt, artificial
  Chemically synthesized
uuguuucuuacagugagc

SEQ ID NO: 5503 - RNA, 18 nt, artificial
  Chemically synthesized
uuuuucugguuccuuguu

SEQ ID NO: 5504 - RNA, 18 nt, artificial
  Chemically synthesized
uccuucacucaggagcag

SEQ ID NO: 5505 - RNA, 18 nt, artificial
  Chemically synthesized
gaaaaugaugugggccug

SEQ ID NO: 5506 - RNA, 18 nt, artificial
  Chemically synthesized
uugcuggacuuaccuucc

SEQ ID NO: 5507 - RNA, 18 nt, artificial
  Chemically synthesized
ucuguuccugcugauccu

SEQ ID NO: 5508 - RNA, 18 nt, artificial
  Chemically synthesized
augugggccuggcuccag

SEQ ID NO: 5509 - RNA, 18 nt, artificial
  Chemically synthesized
agaugccucccucuuacc

SEQ ID NO: 5510 - RNA, 18 nt, artificial
  Chemically synthesized
gugaggaugccuggcccu

SEQ ID NO: 5511 - RNA, 18 nt, artificial
  Chemically synthesized
acucuccaucccaugugc

SEQ ID NO: 5512 - RNA, 18 nt, artificial
  Chemically synthesized
uuugugaagagugagugg

SEQ ID NO: 5513 - RNA, 18 nt, artificial
  Chemically synthesized
aagcagcauauuuuacug

SEQ ID NO: 5514 - RNA, 18 nt, artificial
  Chemically synthesized
uccaacaacaggaucacc

SEQ ID NO: 5515 - RNA, 18 nt, artificial
  Chemically synthesized
uacagugagcgggaugcc

SEQ ID NO: 5516 - RNA, 18 nt, artificial
  Chemically synthesized
aauaacuucauuugcucc

SEQ ID NO: 5517 - RNA, 18 nt, artificial
  Chemically synthesized
uuuuucagaacuauccac

SEQ ID NO: 5518 - RNA, 18 nt, artificial
  Chemically synthesized
aaugaugugggccuggcu

SEQ ID NO: 5519 - RNA, 18 nt, artificial
  Chemically synthesized
aaaugaugugggccuggc

SEQ ID NO: 5520 - RNA, 18 nt, artificial
  Chemically synthesized
uuuucuuugaauuugccg

SEQ ID NO: 5521 - RNA, 18 nt, artificial
  Chemically synthesized
augaaaaugaugugggcc

SEQ ID NO: 5522 - RNA, 18 nt, artificial
  Chemically synthesized
uuacagugagcgggaugc

SEQ ID NO: 5523 - RNA, 18 nt, artificial
  Chemically synthesized
uucuuuuucuucccuggg

SEQ ID NO: 5524 - RNA, 18 nt, artificial
  Chemically synthesized
auucuuuuucuucccugg

SEQ ID NO: 5525 - RNA, 18 nt, artificial
  Chemically synthesized
aagauucuuuuucuuccc

SEQ ID NO: 5526 - RNA, 18 nt, artificial
  Chemically synthesized
uccagguaaaguggaaac

SEQ ID NO: 5527 - RNA, 18 nt, artificial
  Chemically synthesized
uccaucccaugugcgugg

SEQ ID NO: 5528 - RNA, 18 nt, artificial
  Chemically synthesized
uuggccagcaaauuaccu

SEQ ID NO: 5529 - RNA, 18 nt, artificial
  Chemically synthesized
uuaaacuccauucccuca

SEQ ID NO: 5530 - RNA, 18 nt, artificial
  Chemically synthesized
aggaugccuggcccucuc

SEQ ID NO: 5531 - RNA, 18 nt, artificial
  Chemically synthesized
uaugaaaaugaugugggc

SEQ ID NO: 5532 - RNA, 18 nt, artificial
  Chemically synthesized
aaaaugaugugggccugg

SEQ ID NO: 5533 - RNA, 18 nt, artificial
  Chemically synthesized
ugaggaugccuggcccuc

SEQ ID NO: 5534 - RNA, 18 nt, artificial
  Chemically synthesized
uaaaguuuuucugguucc

SEQ ID NO: 5535 - RNA, 18 nt, artificial
  Chemically synthesized
uuauagauccagguaaag

SEQ ID NO: 5536 - RNA, 18 nt, artificial
  Chemically synthesized
ucccaugugcguggccag

SEQ ID NO: 5537 - RNA, 18 nt, artificial
  Chemically synthesized
ugugaggaugccuggccc

SEQ ID NO: 5538 - RNA, 18 nt, artificial
  Chemically synthesized
uuuguggauggugugggu

SEQ ID NO: 5539 - RNA, 18 nt, artificial
  Chemically synthesized
ugugggccuggcuccagg

SEQ ID NO: 5540 - RNA, 18 nt, artificial
  Chemically synthesized
auuggccagcaaauuacc

SEQ ID NO: 5541 - RNA, 18 nt, artificial
  Chemically synthesized
uccaggccaaaaggaagc

SEQ ID NO: 5542 - RNA, 18 nt, artificial
  Chemically synthesized
uucagccugugaggaugc

SEQ ID NO: 5543 - RNA, 18 nt, artificial
  Chemically synthesized
ucagccugugaggaugcc

SEQ ID NO: 5544 - RNA, 18 nt, artificial
  Chemically synthesized
gugggccuggcuccaggc

SEQ ID NO: 5545 - RNA, 18 nt, artificial
  Chemically synthesized
uuuuucuucccugggcag

SEQ ID NO: 5546 - RNA, 18 nt, artificial
  Chemically synthesized
gguaggucuugguguuca

SEQ ID NO: 5547 - RNA, 18 nt, artificial
  Chemically synthesized
cauggguaagagggaggc

SEQ ID NO: 5548 - RNA, 18 nt, artificial
  Chemically synthesized
uccagcaaaaucuuuucu

SEQ ID NO: 5549 - RNA, 18 nt, artificial
  Chemically synthesized
uccugagcugcccuugca

SEQ ID NO: 5550 - RNA, 18 nt, artificial
  Chemically synthesized
gcucuuuucaauggaguc

SEQ ID NO: 5551 - RNA, 18 nt, artificial
  Chemically synthesized
cuuuacuguuuucuacug

SEQ ID NO: 5552 - RNA, 18 nt, artificial
  Chemically synthesized
ugggagaaguccaguuca

SEQ ID NO: 5553 - RNA, 18 nt, artificial
  Chemically synthesized
cugcuucauaugaaggau

SEQ ID NO: 5554 - RNA, 18 nt, artificial
  Chemically synthesized
cuuccuuuuggccuggag

SEQ ID NO: 5555 - RNA, 18 nt, artificial
  Chemically synthesized
aguuuguagagagggcca

SEQ ID NO: 5556 - RNA, 18 nt, artificial
  Chemically synthesized
agggaagaaaaagaaucu

SEQ ID NO: 5557 - RNA, 18 nt, artificial
  Chemically synthesized
aggagcaaaugaaguuau

SEQ ID NO: 5558 - RNA, 18 nt, artificial
  Chemically synthesized
gaaccagaaaaacuuuac

SEQ ID NO: 5559 - RNA, 18 nt, artificial
  Chemically synthesized
accagcuuccaaagucuu

SEQ ID NO: 5560 - RNA, 18 nt, artificial
  Chemically synthesized
gcaguaaaauaugcugcu

SEQ ID NO: 5561 - RNA, 18 nt, artificial
  Chemically synthesized
ugguagagucaucaacuu

SEQ ID NO: 5562 - RNA, 18 nt, artificial
  Chemically synthesized
aacuuucaucggugauuu

SEQ ID NO: 5563 - RNA, 18 nt, artificial
  Chemically synthesized
ugggagcuuuccugggcu

SEQ ID NO: 5564 - RNA, 18 nt, artificial
  Chemically synthesized
aggcaucugguagaguca

SEQ ID NO: 5565 - RNA, 18 nt, artificial
  Chemically synthesized
caauuuugugagaugaga

SEQ ID NO: 5566 - RNA, 18 nt, artificial
  Chemically synthesized
aaacauuccacggaacuu

SEQ ID NO: 5567 - RNA, 18 nt, artificial
  Chemically synthesized
guaggucuugguguucau

SEQ ID NO: 5568 - RNA, 18 nt, artificial
  Chemically synthesized
agucccgcuuaugaagac

SEQ ID NO: 5569 - RNA, 18 nt, artificial
  Chemically synthesized
aaaaagacggaaauggga

SEQ ID NO: 5570 - RNA, 18 nt, artificial
  Chemically synthesized
uaaacaaggaaccagaaa

SEQ ID NO: 5571 - RNA, 18 nt, artificial
  Chemically synthesized
cucuuuucaauggaguca

SEQ ID NO: 5572 - RNA, 18 nt, artificial
  Chemically synthesized
uuagugaagguguccaua

SEQ ID NO: 5573 - RNA, 18 nt, artificial
  Chemically synthesized
ggauggagagucacacag

SEQ ID NO: 5574 - RNA, 18 nt, artificial
  Chemically synthesized
aucuuccucuauuguguu

SEQ ID NO: 5575 - RNA, 18 nt, artificial
  Chemically synthesized
ggauucuuccuuggagag

SEQ ID NO: 5576 - RNA, 18 nt, artificial
  Chemically synthesized
cuuaugaagacacaacuu

SEQ ID NO: 5577 - RNA, 18 nt, artificial
  Chemically synthesized
acaggagcaaaugaaguu

SEQ ID NO: 5578 - RNA, 18 nt, artificial
  Chemically synthesized
aucugguagagucaucaa

SEQ ID NO: 5579 - RNA, 18 nt, artificial
  Chemically synthesized
aucccgcucacuguaaga

SEQ ID NO: 5580 - RNA, 18 nt, artificial
  Chemically synthesized
auggagagucacacaggu

SEQ ID NO: 5581 - RNA, 18 nt, artificial
  Chemically synthesized
augggccacuccagguag

SEQ ID NO: 5582 - RNA, 18 nt, artificial
  Chemically synthesized
cuguuuucuacugugauu

SEQ ID NO: 5583 - RNA, 18 nt, artificial
  Chemically synthesized
aagacagagaagccugau

SEQ ID NO: 5584 - RNA, 18 nt, artificial
  Chemically synthesized
aguuuaaagauccugagc

SEQ ID NO: 5585 - RNA, 18 nt, artificial
  Chemically synthesized
agcuugcagaagcgcugg

SEQ ID NO: 5586 - RNA, 18 nt, artificial
  Chemically synthesized
aggauuucccaguaaguu

SEQ ID NO: 5587 - RNA, 18 nt, artificial
  Chemically synthesized
acaguuuuguggcucuuu

SEQ ID NO: 5588 - RNA, 18 nt, artificial
  Chemically synthesized
acaggcugaauuuuucaa

SEQ ID NO: 5589 - RNA, 18 nt, artificial
  Chemically synthesized
uaggucacuguugcuaau

SEQ ID NO: 5590 - RNA, 18 nt, artificial
  Chemically synthesized
gaaagcacaaagacaguu

SEQ ID NO: 5591 - RNA, 18 nt, artificial
  Chemically synthesized
agcacagcacaugccaga

SEQ ID NO: 5592 - RNA, 18 nt, artificial
  Chemically synthesized
gacuuuggccagugcuug

SEQ ID NO: 5593 - RNA, 18 nt, artificial
  Chemically synthesized
cagguaggucuugguguu

SEQ ID NO: 5594 - RNA, 18 nt, artificial
  Chemically synthesized
cuaauguaggugauccug

SEQ ID NO: 5595 - RNA, 18 nt, artificial
  Chemically synthesized
gaugacuuacauucugaa

SEQ ID NO: 5596 - RNA, 18 nt, artificial
  Chemically synthesized
cacgcacaugggauggag

SEQ ID NO: 5597 - RNA, 18 nt, artificial
  Chemically synthesized
cauuaaggguacagucau

SEQ ID NO: 5598 - RNA, 18 nt, artificial
  Chemically synthesized
aaagacggaaaugggaga

SEQ ID NO: 5599 - RNA, 18 nt, artificial
  Chemically synthesized
gugauccuguuguuggac

SEQ ID NO: 5600 - RNA, 18 nt, artificial
  Chemically synthesized
ggauuucccaguaaguuu

SEQ ID NO: 5601 - RNA, 18 nt, artificial
  Chemically synthesized
acuuuggccagugcuugc

SEQ ID NO: 5602 - RNA, 18 nt, artificial
  Chemically synthesized
cagccuccggauuguuaa

SEQ ID NO: 5603 - RNA, 18 nt, artificial
  Chemically synthesized
gaucagaugacuuacauu

SEQ ID NO: 5604 - RNA, 18 nt, artificial
  Chemically synthesized
aucagcaggaacagagca

SEQ ID NO: 5605 - RNA, 18 nt, artificial
  Chemically synthesized
agauccugagcugcccuu

SEQ ID NO: 5606 - RNA, 18 nt, artificial
  Chemically synthesized
ugcccagggaagaaaaag

SEQ ID NO: 5607 - RNA, 18 nt, artificial
  Chemically synthesized
guccagcaaaaucuuuuc

SEQ ID NO: 5608 - RNA, 18 nt, artificial
  Chemically synthesized
gaaguccaguucauacuu

SEQ ID NO: 5609 - RNA, 18 nt, artificial
  Chemically synthesized
uguauucgugugcuggau

SEQ ID NO: 5610 - RNA, 18 nt, artificial
  Chemically synthesized
ccauccacaaaguaugug

SEQ ID NO: 5611 - RNA, 18 nt, artificial
  Chemically synthesized
aucaaaaagacggaaaug

SEQ ID NO: 5612 - RNA, 18 nt, artificial
  Chemically synthesized
uuccucaaggaagguaag

SEQ ID NO: 5613 - RNA, 18 nt, artificial
  Chemically synthesized
gacggaaaugggagaagu

SEQ ID NO: 5614 - RNA, 18 nt, artificial
  Chemically synthesized
auccuguuguuggacagg

SEQ ID NO: 5615 - RNA, 18 nt, artificial
  Chemically synthesized
uuuaccuggaucuauaac

SEQ ID NO: 5616 - RNA, 18 nt, artificial
  Chemically synthesized
ugagcaggaucagcagga

SEQ ID NO: 5617 - RNA, 18 nt, artificial
  Chemically synthesized
acuuuaccuggaucuaua

SEQ ID NO: 5618 - RNA, 18 nt, artificial
  Chemically synthesized
uccacccaguaggcaucc

SEQ ID NO: 5619 - RNA, 18 nt, artificial
  Chemically synthesized
uggccacgcacaugggau

SEQ ID NO: 5620 - RNA, 18 nt, artificial
  Chemically synthesized
caggcauccucacaggcu

SEQ ID NO: 5621 - RNA, 18 nt, artificial
  Chemically synthesized
agaagccugauuggagga

SEQ ID NO: 5622 - RNA, 18 nt, artificial
  Chemically synthesized
augggauggagagucaca

SEQ ID NO: 5623 - RNA, 18 nt, artificial
  Chemically synthesized
caguggauaguucugaaa

SEQ ID NO: 5624 - RNA, 18 nt, artificial
  Chemically synthesized
cuccuggaccauaagguu

SEQ ID NO: 5625 - RNA, 18 nt, artificial
  Chemically synthesized
gugaagguguccauauuu

SEQ ID NO: 5626 - RNA, 18 nt, artificial
  Chemically synthesized
cuguguauucgugugcug

SEQ ID NO: 5627 - RNA, 18 nt, artificial
  Chemically synthesized
cuucauaugaaggaucag

SEQ ID NO: 5628 - RNA, 18 nt, artificial
  Chemically synthesized
cgcucacuguaagaaaca

SEQ ID NO: 5629 - RNA, 18 nt, artificial
  Chemically synthesized
uccuguuguuggacaggu

SEQ ID NO: 5630 - RNA, 18 nt, artificial
  Chemically synthesized
gguaaguccagcaaaauc

SEQ ID NO: 5631 - RNA, 18 nt, artificial
  Chemically synthesized
cauuggaugucagcacca

SEQ ID NO: 5632 - RNA, 18 nt, artificial
  Chemically synthesized
augauccacuugccagga

SEQ ID NO: 5633 - RNA, 18 nt, artificial
  Chemically synthesized
gagggaggcaucugguag

SEQ ID NO: 5634 - RNA, 18 nt, artificial
  Chemically synthesized
guccaguucauacuugca

SEQ ID NO: 5635 - RNA, 18 nt, artificial
  Chemically synthesized
acaauccagaaaucugau

SEQ ID NO: 5636 - RNA, 18 nt, artificial
  Chemically synthesized
cuuuuggccuggagccag

SEQ ID NO: 5637 - RNA, 18 nt, artificial
  Chemically synthesized
auuugcuggccaaucaau

SEQ ID NO: 5638 - RNA, 18 nt, artificial
  Chemically synthesized
ggaucagaugacuuacau

SEQ ID NO: 5639 - RNA, 18 nt, artificial
  Chemically synthesized
cgcacaugggauggagag

SEQ ID NO: 5640 - RNA, 18 nt, artificial
  Chemically synthesized
aucuccagcaguaaaaua

SEQ ID NO: 5641 - RNA, 18 nt, artificial
  Chemically synthesized
uuccgcagcuugcagaag

SEQ ID NO: 5642 - RNA, 18 nt, artificial
  Chemically synthesized
cuggaccauaagguucuc

SEQ ID NO: 5643 - RNA, 18 nt, artificial
  Chemically synthesized
gauuucccaguaaguuua

SEQ ID NO: 5644 - RNA, 18 nt, artificial
  Chemically synthesized
caugggauggagagucac

SEQ ID NO: 5645 - RNA, 18 nt, artificial
  Chemically synthesized
caggaacagagcacagca

SEQ ID NO: 5646 - RNA, 18 nt, artificial
  Chemically synthesized
gaaugaagucccgcuuau

SEQ ID NO: 5647 - RNA, 18 nt, artificial
  Chemically synthesized
ucggugauuuucacauuu

SEQ ID NO: 5648 - RNA, 18 nt, artificial
  Chemically synthesized
gagucacacagguaauuu

SEQ ID NO: 5649 - RNA, 18 nt, artificial
  Chemically synthesized
ucccgcucacuguaagaa

SEQ ID NO: 5650 - RNA, 18 nt, artificial
  Chemically synthesized
gaauggcagcaucauugu

SEQ ID NO: 5651 - RNA, 18 nt, artificial
  Chemically synthesized
cuuggagaggcugaugau

SEQ ID NO: 5652 - RNA, 18 nt, artificial
  Chemically synthesized
uccucacaggcugaauuu

SEQ ID NO: 5653 - RNA, 18 nt, artificial
  Chemically synthesized
ggucacuguugcuaaugu

SEQ ID NO: 5654 - RNA, 18 nt, artificial
  Chemically synthesized
gccugauuggaggauucu

SEQ ID NO: 5655 - RNA, 18 nt, artificial
  Chemically synthesized
cccaagacccacaccauc

SEQ ID NO: 5656 - RNA, 18 nt, artificial
  Chemically synthesized
ucaucaaaaagacggaaa

SEQ ID NO: 5657 - RNA, 18 nt, artificial
  Chemically synthesized
uuugaguugcggcaaauu

SEQ ID NO: 5658 - RNA, 18 nt, artificial
  Chemically synthesized
gugugcuggauaaguuca

SEQ ID NO: 5659 - RNA, 18 nt, artificial
  Chemically synthesized
cagagaagccugauugga

SEQ ID NO: 5660 - RNA, 18 nt, artificial
  Chemically synthesized
aucggugauuuucacauu

SEQ ID NO: 5661 - RNA, 18 nt, artificial
  Chemically synthesized
gcuugcagaagcgcuggg

SEQ ID NO: 5662 - RNA, 18 nt, artificial
  Chemically synthesized
cuuuggccagugcuugcu

SEQ ID NO: 5663 - RNA, 18 nt, artificial
  Chemically synthesized
ggaacagagcacagcaca

SEQ ID NO: 5664 - RNA, 18 nt, artificial
  Chemically synthesized
aauggcagcaucauuguu

SEQ ID NO: 5665 - RNA, 18 nt, artificial
  Chemically synthesized
uccacuugccaggaauga

SEQ ID NO: 5666 - RNA, 18 nt, artificial
  Chemically synthesized
agagucacacagguaauu

SEQ ID NO: 5667 - RNA, 18 nt, artificial
  Chemically synthesized
ggguacagucaucaaacu

SEQ ID NO: 5668 - RNA, 18 nt, artificial
  Chemically synthesized
aguggauaguucugaaaa

SEQ ID NO: 5669 - RNA, 18 nt, artificial
  Chemically synthesized
uaacauggguaagaggga

SEQ ID NO: 5670 - RNA, 18 nt, artificial
  Chemically synthesized
cagguaauuugcuggcca

SEQ ID NO: 5671 - RNA, 18 nt, artificial
  Chemically synthesized
gaugagaaaaaagagaug

SEQ ID NO: 5672 - RNA, 18 nt, artificial
  Chemically synthesized
guaagagggaggcaucug

SEQ ID NO: 5673 - RNA, 18 nt, artificial
  Chemically synthesized
guaaaauaugcugcuuca

SEQ ID NO: 5674 - RNA, 18 nt, artificial
  Chemically synthesized
uggagagucacacaggua

SEQ ID NO: 5675 - RNA, 18 nt, artificial
  Chemically synthesized
aaaaucuccagcaguaaa

SEQ ID NO: 5676 - RNA, 18 nt, artificial
  Chemically synthesized
agaggcggacauccugaa

SEQ ID NO: 5677 - RNA, 18 nt, artificial
  Chemically synthesized
uugcugcuccugagugaa

SEQ ID NO: 5678 - RNA, 18 nt, artificial
  Chemically synthesized
uuuccacuuuaccuggau

SEQ ID NO: 5679 - RNA, 18 nt, artificial
  Chemically synthesized
gcacagcacaugccagac

SEQ ID NO: 5680 - RNA, 18 nt, artificial
  Chemically synthesized
ggaauggaguuuaaagau

SEQ ID NO: 5681 - RNA, 18 nt, artificial
  Chemically synthesized
caagacccacaccaucca

SEQ ID NO: 5682 - RNA, 18 nt, artificial
  Chemically synthesized
agcaggaacagagcacag

SEQ ID NO: 5683 - RNA, 18 nt, artificial
  Chemically synthesized
auaugcagccuccggauu

SEQ ID NO: 5684 - RNA, 18 nt, artificial
  Chemically synthesized
aguaggcaucccgcucac

SEQ ID NO: 5685 - RNA, 18 nt, artificial
  Chemically synthesized
aaaaaucuccagcaguaa

SEQ ID NO: 5686 - RNA, 18 nt, artificial
  Chemically synthesized
ccaguggauaguucugaa

SEQ ID NO: 5687 - RNA, 18 nt, artificial
  Chemically synthesized
cuguuguuggacagguca

SEQ ID NO: 5688 - RNA, 18 nt, artificial
  Chemically synthesized
agcaggaucagcaggaac

SEQ ID NO: 5689 - RNA, 18 nt, artificial
  Chemically synthesized
ugggccacuccagguagg

SEQ ID NO: 5690 - RNA, 18 nt, artificial
  Chemically synthesized
ugugcuggauaaguucaa

SEQ ID NO: 5691 - RNA, 18 nt, artificial
  Chemically synthesized
auggaguuuaaagauccu

SEQ ID NO: 5692 - RNA, 18 nt, artificial
  Chemically synthesized
gccuguuacacuguguau

SEQ ID NO: 5693 - RNA, 18 nt, artificial
  Chemically synthesized
aguuccucaaggaaggua

SEQ ID NO: 5694 - RNA, 18 nt, artificial
  Chemically synthesized
uccacaaaguauguggca

SEQ ID NO: 5695 - RNA, 18 nt, artificial
  Chemically synthesized
agugcuugcugcuccuga

SEQ ID NO: 5696 - RNA, 18 nt, artificial
  Chemically synthesized
aguuuucagaaagcacaa

SEQ ID NO: 5697 - RNA, 18 nt, artificial
  Chemically synthesized
cagcuccuggaccauaag

SEQ ID NO: 5698 - RNA, 18 nt, artificial
  Chemically synthesized
gaggcggacauccugaac

SEQ ID NO: 5699 - RNA, 18 nt, artificial
  Chemically synthesized
gagaggcggacauccuga

SEQ ID NO: 5700 - RNA, 18 nt, artificial
  Chemically synthesized
gaagguaaguccagcaaa

SEQ ID NO: 5701 - RNA, 18 nt, artificial
  Chemically synthesized
ggguuuuguaaggauuuc

SEQ ID NO: 5702 - RNA, 18 nt, artificial
  Chemically synthesized
ccgcuuaugaagacacaa

SEQ ID NO: 5703 - RNA, 18 nt, artificial
  Chemically synthesized
ccagaaaaacuuuacugu

SEQ ID NO: 5704 - RNA, 18 nt, artificial
  Chemically synthesized
cacuccagguaggucuug

SEQ ID NO: 5705 - RNA, 18 nt, artificial
  Chemically synthesized
gucccgcuuaugaagaca

SEQ ID NO: 5706 - RNA, 18 nt, artificial
  Chemically synthesized
uauucgugugcuggauaa

SEQ ID NO: 5707 - RNA, 18 nt, artificial
  Chemically synthesized
gcucauagcucuguagau

SEQ ID NO: 5708 - RNA, 18 nt, artificial
  Chemically synthesized
acgcacaugggauggaga

SEQ ID NO: 5709 - RNA, 18 nt, artificial
  Chemically synthesized
cuaguaacauggguaaga

SEQ ID NO: 5710 - RNA, 18 nt, artificial
  Chemically synthesized
aagguaaguccagcaaaa

SEQ ID NO: 5711 - RNA, 18 nt, artificial
  Chemically synthesized
uucuuugaguugcggcaa

SEQ ID NO: 5712 - RNA, 18 nt, artificial
  Chemically synthesized
aagacggaaaugggagaa

SEQ ID NO: 5713 - RNA, 18 nt, artificial
  Chemically synthesized
cacagcacaugccagaca

SEQ ID NO: 5714 - RNA, 18 nt, artificial
  Chemically synthesized
gucaaguugcuccuuaga

SEQ ID NO: 5715 - RNA, 18 nt, artificial
  Chemically synthesized
aggcccacaucauuuuca

SEQ ID NO: 5716 - RNA, 18 nt, artificial
  Chemically synthesized
gcucucagauuuacccaa

SEQ ID NO: 5717 - RNA, 18 nt, artificial
  Chemically synthesized
agggaggcaucugguaga

SEQ ID NO: 5718 - RNA, 18 nt, artificial
  Chemically synthesized
gcuuuccugggcuuccuu

SEQ ID NO: 5719 - RNA, 18 nt, artificial
  Chemically synthesized
caaaaaucuccagcagua

SEQ ID NO: 5720 - RNA, 18 nt, artificial
  Chemically synthesized
gcaggaucagcaggaaca

SEQ ID NO: 5721 - RNA, 18 nt, artificial
  Chemically synthesized
aaguuccucaaggaaggu

SEQ ID NO: 5722 - RNA, 18 nt, artificial
  Chemically synthesized
ccugauuggaggauucuu

SEQ ID NO: 5723 - RNA, 18 nt, artificial
  Chemically synthesized
ugcuugcugcuccugagu

SEQ ID NO: 5724 - RNA, 18 nt, artificial
  Chemically synthesized
acaugggauggagaguca

SEQ ID NO: 5725 - RNA, 18 nt, artificial
  Chemically synthesized
aguuauugccaccagcuu

SEQ ID NO: 5726 - RNA, 18 nt, artificial
  Chemically synthesized
ggcggacauccugaaccu

SEQ ID NO: 5727 - RNA, 18 nt, artificial
  Chemically synthesized
gacaggucaaggcuuuuu

SEQ ID NO: 5728 - RNA, 18 nt, artificial
  Chemically synthesized
aguaucucgcaguuccaa

SEQ ID NO: 5729 - RNA, 18 nt, artificial
  Chemically synthesized
ggaaugcagccuguuaca

SEQ ID NO: 5730 - RNA, 18 nt, artificial
  Chemically synthesized
ccucuguaggucacuguu

SEQ ID NO: 5731 - RNA, 18 nt, artificial
  Chemically synthesized
cauccucacaggcugaau

SEQ ID NO: 5732 - RNA, 18 nt, artificial
  Chemically synthesized
accauccacaaaguaugu

SEQ ID NO: 5733 - RNA, 18 nt, artificial
  Chemically synthesized
auggguaagagggaggca

SEQ ID NO: 5734 - RNA, 18 nt, artificial
  Chemically synthesized
caaacuuucaucggugau

SEQ ID NO: 5735 - RNA, 18 nt, artificial
  Chemically synthesized
cgcagcuugcagaagcgc

SEQ ID NO: 5736 - RNA, 18 nt, artificial
  Chemically synthesized
caagacagagaagccuga

SEQ ID NO: 5737 - RNA, 18 nt, artificial
  Chemically synthesized
ccaguaggcaucccgcuc

SEQ ID NO: 5738 - RNA, 18 nt, artificial
  Chemically synthesized
gaacagagcacagcacau

SEQ ID NO: 5739 - RNA, 18 nt, artificial
  Chemically synthesized
caggagcaaaugaaguua

SEQ ID NO: 5740 - RNA, 18 nt, artificial
  Chemically synthesized
ggaauucacaggagcaaa

SEQ ID NO: 5741 - RNA, 18 nt, artificial
  Chemically synthesized
ggagcuuuccugggcuuc

SEQ ID NO: 5742 - RNA, 18 nt, artificial
  Chemically synthesized
aacuccauuaaggguaca

SEQ ID NO: 5743 - RNA, 18 nt, artificial
  Chemically synthesized
aggaauucacaggagcaa

SEQ ID NO: 5744 - RNA, 18 nt, artificial
  Chemically synthesized
ggagaaguccaguucaua

SEQ ID NO: 5745 - RNA, 18 nt, artificial
  Chemically synthesized
gacccacaccauccacaa

SEQ ID NO: 5746 - RNA, 18 nt, artificial
  Chemically synthesized
ggucacaagacagagaag

SEQ ID NO: 5747 - RNA, 18 nt, artificial
  Chemically synthesized
agguaaguccagcaaaau

SEQ ID NO: 5748 - RNA, 18 nt, artificial
  Chemically synthesized
cacuuuaccuggaucuau

SEQ ID NO: 5749 - RNA, 18 nt, artificial
  Chemically synthesized
agagggaggcaucuggua

SEQ ID NO: 5750 - RNA, 18 nt, artificial
  Chemically synthesized
ggccacuccagguagguc

SEQ ID NO: 5751 - RNA, 18 nt, artificial
  Chemically synthesized
ugacaaguuucaggcaua

SEQ ID NO: 5752 - RNA, 18 nt, artificial
  Chemically synthesized
caggaucagcaggaacag

SEQ ID NO: 5753 - RNA, 18 nt, artificial
  Chemically synthesized
uggagccaggcccacauc

SEQ ID NO: 5754 - RNA, 18 nt, artificial
  Chemically synthesized
cauuccacggaacuugua

SEQ ID NO: 5755 - RNA, 18 nt, artificial
  Chemically synthesized
ccaggcauccucacaggc

SEQ ID NO: 5756 - RNA, 18 nt, artificial
  Chemically synthesized
gaagccugauuggaggau

SEQ ID NO: 5757 - RNA, 18 nt, artificial
  Chemically synthesized
ggcugaauuuuucaagua

SEQ ID NO: 5758 - RNA, 18 nt, artificial
  Chemically synthesized
ggccaggcauccucacag

SEQ ID NO: 5759 - RNA, 18 nt, artificial
  Chemically synthesized
gccacgcacaugggaugg

SEQ ID NO: 5760 - RNA, 18 nt, artificial
  Chemically synthesized
ugcagccuccggauuguu

SEQ ID NO: 5761 - RNA, 18 nt, artificial
  Chemically synthesized
guaaacaaggaaccagaa

SEQ ID NO: 5762 - RNA, 18 nt, artificial
  Chemically synthesized
cccaguaggcaucccgcu

SEQ ID NO: 5763 - RNA, 18 nt, artificial
  Chemically synthesized
gagagucacacagguaau

SEQ ID NO: 5764 - RNA, 18 nt, artificial
  Chemically synthesized
gacaguuuuguggcucuu

SEQ ID NO: 5765 - RNA, 18 nt, artificial
  Chemically synthesized
ucgcagcucucagauuua

SEQ ID NO: 5766 - RNA, 18 nt, artificial
  Chemically synthesized
cucucagauuuacccaaa

SEQ ID NO: 5767 - RNA, 18 nt, artificial
  Chemically synthesized
cacaaaguauguggcauu

SEQ ID NO: 5768 - RNA, 18 nt, artificial
  Chemically synthesized
ucuuccucuauuguguua

SEQ ID NO: 5769 - RNA, 18 nt, artificial
  Chemically synthesized
caguaggcaucccgcuca

SEQ ID NO: 5770 - RNA, 18 nt, artificial
  Chemically synthesized
uguuguuggacaggucaa

SEQ ID NO: 5771 - RNA, 18 nt, artificial
  Chemically synthesized
gagccaggcccacaucau

SEQ ID NO: 5772 - RNA, 18 nt, artificial
  Chemically synthesized
ggcuuccuuuuggccugg

SEQ ID NO: 5773 - RNA, 18 nt, artificial
  Chemically synthesized
guuuucagaaagcacaaa

SEQ ID NO: 5774 - RNA, 18 nt, artificial
  Chemically synthesized
acuuucaucggugauuuu

SEQ ID NO: 5775 - RNA, 18 nt, artificial
  Chemically synthesized
cugagggaauggaguuua

SEQ ID NO: 5776 - RNA, 18 nt, artificial
  Chemically synthesized
acaaacuuucaucgguga

SEQ ID NO: 5777 - RNA, 18 nt, artificial
  Chemically synthesized
aguugcggcaaauucaaa

SEQ ID NO: 5778 - RNA, 18 nt, artificial
  Chemically synthesized
cuugcugcuccugaguga

SEQ ID NO: 5779 - RNA, 18 nt, artificial
  Chemically synthesized
ccacuccagguaggucuu

SEQ ID NO: 5780 - RNA, 18 nt, artificial
  Chemically synthesized
gggaggcaucugguagag

SEQ ID NO: 5781 - RNA, 18 nt, artificial
  Chemically synthesized
guaggcaucccgcucacu

SEQ ID NO: 5782 - RNA, 18 nt, artificial
  Chemically synthesized
ccacaccauccacaaagu

SEQ ID NO: 5783 - RNA, 18 nt, artificial
  Chemically synthesized
gccaggcauccucacagg

SEQ ID NO: 5784 - RNA, 18 nt, artificial
  Chemically synthesized
ggcaucugguagagucau

SEQ ID NO: 5785 - RNA, 18 nt, artificial
  Chemically synthesized
ggaaugaagucccgcuua

SEQ ID NO: 5786 - RNA, 18 nt, artificial
  Chemically synthesized
caugggccacuccaggua

SEQ ID NO: 5787 - RNA, 18 nt, artificial
  Chemically synthesized
ucucagauuuacccaaaa

SEQ ID NO: 5788 - RNA, 18 nt, artificial
  Chemically synthesized
ccagugcuugcugcuccu

SEQ ID NO: 5789 - RNA, 18 nt, artificial
  Chemically synthesized
ggaggcaucugguagagu

SEQ ID NO: 5790 - RNA, 18 nt, artificial
  Chemically synthesized
ugauccacuugccaggaa

SEQ ID NO: 5791 - RNA, 18 nt, artificial
  Chemically synthesized
cacaccauccacaaagua

SEQ ID NO: 5792 - RNA, 18 nt, artificial
  Chemically synthesized
cagugcuugcugcuccug

SEQ ID NO: 5793 - RNA, 18 nt, artificial
  Chemically synthesized
uccagcuccuggaccaua

SEQ ID NO: 5794 - RNA, 18 nt, artificial
  Chemically synthesized
aggaaccagaaaaacuuu

SEQ ID NO: 5795 - RNA, 18 nt, artificial
  Chemically synthesized
gcucacuguaagaaacaa

SEQ ID NO: 5796 - RNA, 18 nt, artificial
  Chemically synthesized
aacaaggaaccagaaaaa

SEQ ID NO: 5797 - RNA, 18 nt, artificial
  Chemically synthesized
cugcuccugagugaagga

SEQ ID NO: 5798 - RNA, 18 nt, artificial
  Chemically synthesized
caggcccacaucauuuuc

SEQ ID NO: 5799 - RNA, 18 nt, artificial
  Chemically synthesized
ggaagguaaguccagcaa

SEQ ID NO: 5800 - RNA, 18 nt, artificial
  Chemically synthesized
aggaucagcaggaacaga

SEQ ID NO: 5801 - RNA, 18 nt, artificial
  Chemically synthesized
cuggagccaggcccacau

SEQ ID NO: 5802 - RNA, 18 nt, artificial
  Chemically synthesized
gguaagagggaggcaucu

SEQ ID NO: 5803 - RNA, 18 nt, artificial
  Chemically synthesized
agggccaggcauccucac

SEQ ID NO: 5804 - RNA, 18 nt, artificial
  Chemically synthesized
gcacaugggauggagagu

SEQ ID NO: 5805 - RNA, 18 nt, artificial
  Chemically synthesized
ccacucacucuucacaaa

SEQ ID NO: 5806 - RNA, 18 nt, artificial
  Chemically synthesized
caguaaaauaugcugcuu

SEQ ID NO: 5807 - RNA, 18 nt, artificial
  Chemically synthesized
ggugauccuguuguugga

SEQ ID NO: 5808 - RNA, 18 nt, artificial
  Chemically synthesized
ggcaucccgcucacugua

SEQ ID NO: 5809 - RNA, 18 nt, artificial
  Chemically synthesized
ggagcaaaugaaguuauu

SEQ ID NO: 5810 - RNA, 18 nt, artificial
  Chemically synthesized
guggauaguucugaaaaa

SEQ ID NO: 5811 - RNA, 18 nt, artificial
  Chemically synthesized
agccaggcccacaucauu

SEQ ID NO: 5812 - RNA, 18 nt, artificial
  Chemically synthesized
gccaggcccacaucauuu

SEQ ID NO: 5813 - RNA, 18 nt, artificial
  Chemically synthesized
cggcaaauucaaagaaaa

SEQ ID NO: 5814 - RNA, 18 nt, artificial
  Chemically synthesized
ggcccacaucauuuucau

SEQ ID NO: 5815 - RNA, 18 nt, artificial
  Chemically synthesized
gcaucccgcucacuguaa

SEQ ID NO: 5816 - RNA, 18 nt, artificial
  Chemically synthesized
cccagggaagaaaaagaa

SEQ ID NO: 5817 - RNA, 18 nt, artificial
  Chemically synthesized
ccagggaagaaaaagaau

SEQ ID NO: 5818 - RNA, 18 nt, artificial
  Chemically synthesized
gggaagaaaaagaaucuu

SEQ ID NO: 5819 - RNA, 18 nt, artificial
  Chemically synthesized
guuuccacuuuaccugga

SEQ ID NO: 5820 - RNA, 18 nt, artificial
  Chemically synthesized
ccacgcacaugggaugga

SEQ ID NO: 5821 - RNA, 18 nt, artificial
  Chemically synthesized
agguaauuugcuggccaa

SEQ ID NO: 5822 - RNA, 18 nt, artificial
  Chemically synthesized
ugagggaauggaguuuaa

SEQ ID NO: 5823 - RNA, 18 nt, artificial
  Chemically synthesized
gagagggccaggcauccu

SEQ ID NO: 5824 - RNA, 18 nt, artificial
  Chemically synthesized
gcccacaucauuuucaua

SEQ ID NO: 5825 - RNA, 18 nt, artificial
  Chemically synthesized
ccaggcccacaucauuuu

SEQ ID NO: 5826 - RNA, 18 nt, artificial
  Chemically synthesized
gagggccaggcauccuca

SEQ ID NO: 5827 - RNA, 18 nt, artificial
  Chemically synthesized
ggaaccagaaaaacuuua

SEQ ID NO: 5828 - RNA, 18 nt, artificial
  Chemically synthesized
cuuuaccuggaucuauaa

SEQ ID NO: 5829 - RNA, 18 nt, artificial
  Chemically synthesized
cuggccacgcacauggga

SEQ ID NO: 5830 - RNA, 18 nt, artificial
  Chemically synthesized
gggccaggcauccucaca

SEQ ID NO: 5831 - RNA, 18 nt, artificial
  Chemically synthesized
acccacaccauccacaaa

SEQ ID NO: 5832 - RNA, 18 nt, artificial
  Chemically synthesized
ccuggagccaggcccaca

SEQ ID NO: 5833 - RNA, 18 nt, artificial
  Chemically synthesized
gguaauuugcuggccaau

SEQ ID NO: 5834 - RNA, 18 nt, artificial
  Chemically synthesized
gcuuccuuuuggccugga

SEQ ID NO: 5835 - RNA, 18 nt, artificial
  Chemically synthesized
gcauccucacaggcugaa

SEQ ID NO: 5836 - RNA, 18 nt, artificial
  Chemically synthesized
ggcauccucacaggcuga

SEQ ID NO: 5837 - RNA, 18 nt, artificial
  Chemically synthesized
gccuggagccaggcccac

SEQ ID NO: 5838 - RNA, 18 nt, Artificial Sequence
  Chemically synthesized
cugcccagggaagaaaaa

SEQ ID NO: 5839 - RNA, 19 nt, artificial
  Chemically synthesized
ggcuguggagacaaaucua

SEQ ID NO: 5840 - RNA, 19 nt, artificial
  Chemically synthesized
gggagaauuuagaaaugaa

SEQ ID NO: 5841 - RNA, 19 nt, artificial
  Chemically synthesized
ggaguugucuaauugguau

SEQ ID NO: 5842 - RNA, 19 nt, artificial
  Chemically synthesized
ggcuugaguuucaaagguu

SEQ ID NO: 5843 - RNA, 19 nt, artificial
  Chemically synthesized
ggucuagggugauugaaca

SEQ ID NO: 5844 - RNA, 19 nt, artificial
  Chemically synthesized
gggaguugucuaauuggua

SEQ ID NO: 5845 - RNA, 19 nt, artificial
  Chemically synthesized
ggaaauagggaguugucua

SEQ ID NO: 5846 - RNA, 19 nt, artificial
  Chemically synthesized
guuucuagaucucaguaga

SEQ ID NO: 5847 - RNA, 19 nt, artificial
  Chemically synthesized
ggauguuaucauugagaaa

SEQ ID NO: 5848 - RNA, 19 nt, artificial
  Chemically synthesized
ggugagugugacuauugaa

SEQ ID NO: 5849 - RNA, 19 nt, artificial
  Chemically synthesized
ggcucacaaucuuauccaa

SEQ ID NO: 5850 - RNA, 19 nt, artificial
  Chemically synthesized
gucuuaucauggacaauuu

SEQ ID NO: 5851 - RNA, 19 nt, artificial
  Chemically synthesized
agaagagagugugauuaua

SEQ ID NO: 5852 - RNA, 19 nt, artificial
  Chemically synthesized
gaguugucuaauugguaua

SEQ ID NO: 5853 - RNA, 19 nt, artificial
  Chemically synthesized
ggcaauucuuuccaggaaa

SEQ ID NO: 5854 - RNA, 19 nt, artificial
  Chemically synthesized
cccagaacugcuuugaaua

SEQ ID NO: 5855 - RNA, 19 nt, artificial
  Chemically synthesized
gcaugaucauaucuguaua

SEQ ID NO: 5856 - RNA, 19 nt, artificial
  Chemically synthesized
guuugagaugaguucucua

SEQ ID NO: 5857 - RNA, 19 nt, artificial
  Chemically synthesized
cagacuugcggguucuaca

SEQ ID NO: 5858 - RNA, 19 nt, artificial
  Chemically synthesized
ggaaugagcuaguaaagaa

SEQ ID NO: 5859 - RNA, 19 nt, artificial
  Chemically synthesized
gucuauggcuguuugagau

SEQ ID NO: 5860 - RNA, 19 nt, artificial
  Chemically synthesized
ggugugaaauccagacaau

SEQ ID NO: 5861 - RNA, 19 nt, artificial
  Chemically synthesized
ccaccucucuaccuuaaua

SEQ ID NO: 5862 - RNA, 19 nt, artificial
  Chemically synthesized
gccuugaguuucuagaucu

SEQ ID NO: 5863 - RNA, 19 nt, artificial
  Chemically synthesized
ugguggcuguggagacaaa

SEQ ID NO: 5864 - RNA, 19 nt, artificial
  Chemically synthesized
gaaauagggaguugucuaa

SEQ ID NO: 5865 - RNA, 19 nt, artificial
  Chemically synthesized
gaguugcagcagaaguuua

SEQ ID NO: 5866 - RNA, 19 nt, artificial
  Chemically synthesized
ccuucacuacagagacuuu

SEQ ID NO: 5867 - RNA, 19 nt, artificial
  Chemically synthesized
gaagguucccagaaaagaa

SEQ ID NO: 5868 - RNA, 19 nt, artificial
  Chemically synthesized
aggucuggcugguuuagaa

SEQ ID NO: 5869 - RNA, 19 nt, artificial
  Chemically synthesized
cucuugugcuuguacagua

SEQ ID NO: 5870 - RNA, 19 nt, artificial
  Chemically synthesized
cauccagccuccucagaaa

SEQ ID NO: 5871 - RNA, 19 nt, artificial
  Chemically synthesized
cuuucaaauuaccugagua

SEQ ID NO: 5872 - RNA, 19 nt, artificial
  Chemically synthesized
guggcuaauuccuaaggaa

SEQ ID NO: 5873 - RNA, 19 nt, artificial
  Chemically synthesized
gggaguauacauugcuguu

SEQ ID NO: 5874 - RNA, 19 nt, artificial
  Chemically synthesized
agcucuugguggaaguuga

SEQ ID NO: 5875 - RNA, 19 nt, artificial
  Chemically synthesized
gucucauguacuagugaaa

SEQ ID NO: 5876 - RNA, 19 nt, artificial
  Chemically synthesized
cgagcauguucuauuuuuu

SEQ ID NO: 5877 - RNA, 19 nt, artificial
  Chemically synthesized
gcuguuuccuguugggcaa

SEQ ID NO: 5878 - RNA, 19 nt, artificial
  Chemically synthesized
ggcuuacuuucacuuccaa

SEQ ID NO: 5879 - RNA, 19 nt, artificial
  Chemically synthesized
agaguuuccugcaauggau

SEQ ID NO: 5880 - RNA, 19 nt, artificial
  Chemically synthesized
ccuuaauauugacaggaaa

SEQ ID NO: 5881 - RNA, 19 nt, artificial
  Chemically synthesized
gcaauucuuuccaggaaaa

SEQ ID NO: 5882 - RNA, 19 nt, artificial
  Chemically synthesized
gcauuuuccaaguagucua

SEQ ID NO: 5883 - RNA, 19 nt, artificial
  Chemically synthesized
agccaccucucuaccuuaa

SEQ ID NO: 5884 - RNA, 19 nt, artificial
  Chemically synthesized
cacauaaugacuuccaaaa

SEQ ID NO: 5885 - RNA, 19 nt, artificial
  Chemically synthesized
ggguaaaagacuuuucuua

SEQ ID NO: 5886 - RNA, 19 nt, artificial
  Chemically synthesized
gguccucagugugcuugua

SEQ ID NO: 5887 - RNA, 19 nt, artificial
  Chemically synthesized
cuguaaauuuggacaguuu

SEQ ID NO: 5888 - RNA, 19 nt, artificial
  Chemically synthesized
ggcggcucgaggaagagaa

SEQ ID NO: 5889 - RNA, 19 nt, artificial
  Chemically synthesized
ggaguauacauugcuguuu

SEQ ID NO: 5890 - RNA, 19 nt, artificial
  Chemically synthesized
aguagucuagcuuucuuaa

SEQ ID NO: 5891 - RNA, 19 nt, artificial
  Chemically synthesized
gaguuucuagaucucagua

SEQ ID NO: 5892 - RNA, 19 nt, artificial
  Chemically synthesized
gccuuuguuaucuacucaa

SEQ ID NO: 5893 - RNA, 19 nt, artificial
  Chemically synthesized
gggcauuucaaccaacuca

SEQ ID NO: 5894 - RNA, 19 nt, artificial
  Chemically synthesized
ugaccaaucuagagcacuu

SEQ ID NO: 5895 - RNA, 19 nt, artificial
  Chemically synthesized
gcuugaguuucaaagguug

SEQ ID NO: 5896 - RNA, 19 nt, artificial
  Chemically synthesized
caugaagguuuccauaaaa

SEQ ID NO: 5897 - RNA, 19 nt, artificial
  Chemically synthesized
ggaccucugaaucucuuua

SEQ ID NO: 5898 - RNA, 19 nt, artificial
  Chemically synthesized
ggucuuaucauggacaauu

SEQ ID NO: 5899 - RNA, 19 nt, artificial
  Chemically synthesized
gguggcuguggagacaaau

SEQ ID NO: 5900 - RNA, 19 nt, artificial
  Chemically synthesized
cucucaaaaggcuuacuuu

SEQ ID NO: 5901 - RNA, 19 nt, artificial
  Chemically synthesized
gacaaaucuagcaucucua

SEQ ID NO: 5902 - RNA, 19 nt, artificial
  Chemically synthesized
cuggagacgacucagaaaa

SEQ ID NO: 5903 - RNA, 19 nt, artificial
  Chemically synthesized
caaugugucuggaauuaau

SEQ ID NO: 5904 - RNA, 19 nt, artificial
  Chemically synthesized
guuugguucugggagaauu

SEQ ID NO: 5905 - RNA, 19 nt, artificial
  Chemically synthesized
gaagagagugugauuauau

SEQ ID NO: 5906 - RNA, 19 nt, artificial
  Chemically synthesized
ggaaauaugaccacaguca

SEQ ID NO: 5907 - RNA, 19 nt, artificial
  Chemically synthesized
augcuaagggugaguaauu

SEQ ID NO: 5908 - RNA, 19 nt, artificial
  Chemically synthesized
gcguuuucuucuucuaacu

SEQ ID NO: 5909 - RNA, 19 nt, artificial
  Chemically synthesized
gacaguuucccacauugaa

SEQ ID NO: 5910 - RNA, 19 nt, artificial
  Chemically synthesized
gagaaaacagaaagagaca

SEQ ID NO: 5911 - RNA, 19 nt, artificial
  Chemically synthesized
gggcaaugcuccuugacca

SEQ ID NO: 5912 - RNA, 19 nt, artificial
  Chemically synthesized
gucugaaugaagcuauaaa

SEQ ID NO: 5913 - RNA, 19 nt, artificial
  Chemically synthesized
agacuugcggguucuacau

SEQ ID NO: 5914 - RNA, 19 nt, artificial
  Chemically synthesized
ggccuuaugcuaaggguga

SEQ ID NO: 5915 - RNA, 19 nt, artificial
  Chemically synthesized
agaaauggcuugaguuuca

SEQ ID NO: 5916 - RNA, 19 nt, artificial
  Chemically synthesized
caguucuggucuauaaguu

SEQ ID NO: 5917 - RNA, 19 nt, artificial
  Chemically synthesized
gugacuauugaaaggguaa

SEQ ID NO: 5918 - RNA, 19 nt, artificial
  Chemically synthesized
guagaaauggcuugaguuu

SEQ ID NO: 5919 - RNA, 19 nt, artificial
  Chemically synthesized
ggcuguuugagaugaguuc

SEQ ID NO: 5920 - RNA, 19 nt, artificial
  Chemically synthesized
ucuagaucucaguagaaau

SEQ ID NO: 5921 - RNA, 19 nt, artificial
  Chemically synthesized
agaacuacgugugaaggua

SEQ ID NO: 5922 - RNA, 19 nt, artificial
  Chemically synthesized
gugacaaaagagauaacua

SEQ ID NO: 5923 - RNA, 19 nt, artificial
  Chemically synthesized
cacucagaaaccucauuua

SEQ ID NO: 5924 - RNA, 19 nt, artificial
  Chemically synthesized
ggcaacauuuagaauuagu

SEQ ID NO: 5925 - RNA, 19 nt, artificial
  Chemically synthesized
caccagaguugcuuucaau

SEQ ID NO: 5926 - RNA, 19 nt, artificial
  Chemically synthesized
ugcggguucuacaucaaau

SEQ ID NO: 5927 - RNA, 19 nt, artificial
  Chemically synthesized
gcuuguaguaucuguugua

SEQ ID NO: 5928 - RNA, 19 nt, artificial
  Chemically synthesized
guugaauaaagacagagaa

SEQ ID NO: 5929 - RNA, 19 nt, artificial
  Chemically synthesized
gcaguucuggucuauaagu

SEQ ID NO: 5930 - RNA, 19 nt, artificial
  Chemically synthesized
aguugaucuaccaagccuu

SEQ ID NO: 5931 - RNA, 19 nt, artificial
  Chemically synthesized
augucugaaugaagcuaua

SEQ ID NO: 5932 - RNA, 19 nt, artificial
  Chemically synthesized
gaguuuucaguauuccuau

SEQ ID NO: 5933 - RNA, 19 nt, artificial
  Chemically synthesized
ggaaguauggaaaaguaca

SEQ ID NO: 5934 - RNA, 19 nt, artificial
  Chemically synthesized
gcugguggcuguggagaca

SEQ ID NO: 5935 - RNA, 19 nt, artificial
  Chemically synthesized
cacucgaugucauuccaaa

SEQ ID NO: 5936 - RNA, 19 nt, artificial
  Chemically synthesized
gagucuuccaggugggcau

SEQ ID NO: 5937 - RNA, 19 nt, artificial
  Chemically synthesized
guuugacaaaucugcucua

SEQ ID NO: 5938 - RNA, 19 nt, artificial
  Chemically synthesized
agaugaguucucuacucuu

SEQ ID NO: 5939 - RNA, 19 nt, artificial
  Chemically synthesized
cuuucaauggcaucuucaa

SEQ ID NO: 5940 - RNA, 19 nt, artificial
  Chemically synthesized
ggaagggagaaaugaggaa

SEQ ID NO: 5941 - RNA, 19 nt, artificial
  Chemically synthesized
cgugcuucaaauauccaua

SEQ ID NO: 5942 - RNA, 19 nt, artificial
  Chemically synthesized
gccgaaaggugauuguugu

SEQ ID NO: 5943 - RNA, 19 nt, artificial
  Chemically synthesized
cagucagaaguguuuguua

SEQ ID NO: 5944 - RNA, 19 nt, artificial
  Chemically synthesized
ccugugacaaaagagauaa

SEQ ID NO: 5945 - RNA, 19 nt, artificial
  Chemically synthesized
ggcaggaagcaacaucuau

SEQ ID NO: 5946 - RNA, 19 nt, artificial
  Chemically synthesized
gggcuguguguauuugaaa

SEQ ID NO: 5947 - RNA, 19 nt, artificial
  Chemically synthesized
gucucgaagucuugaaaau

SEQ ID NO: 5948 - RNA, 19 nt, artificial
  Chemically synthesized
aaagaagguucccagaaaa

SEQ ID NO: 5949 - RNA, 19 nt, artificial
  Chemically synthesized
guucuugauuacagucuca

SEQ ID NO: 5950 - RNA, 19 nt, artificial
  Chemically synthesized
ggaucaaggaccagaggca

SEQ ID NO: 5951 - RNA, 19 nt, artificial
  Chemically synthesized
gagucuuuugaauggaaau

SEQ ID NO: 5952 - RNA, 19 nt, artificial
  Chemically synthesized
ccagguucuugauuacagu

SEQ ID NO: 5953 - RNA, 19 nt, artificial
  Chemically synthesized
ggcagcagguggagcugua

SEQ ID NO: 5954 - RNA, 19 nt, artificial
  Chemically synthesized
guuugauggaccucugaau

SEQ ID NO: 5955 - RNA, 19 nt, artificial
  Chemically synthesized
ggauggcaacauuuagaau

SEQ ID NO: 5956 - RNA, 19 nt, artificial
  Chemically synthesized
ggcugguuuagaaguccau

SEQ ID NO: 5957 - RNA, 19 nt, artificial
  Chemically synthesized
aauagggaguugucuaauu

SEQ ID NO: 5958 - RNA, 19 nt, artificial
  Chemically synthesized
acaucauccaugaagguuu

SEQ ID NO: 5959 - RNA, 19 nt, artificial
  Chemically synthesized
aguccagaaugcuaagguu

SEQ ID NO: 5960 - RNA, 19 nt, artificial
  Chemically synthesized
accucaucaaguugaauaa

SEQ ID NO: 5961 - RNA, 19 nt, artificial
  Chemically synthesized
gaugaauaagaccaucauu

SEQ ID NO: 5962 - RNA, 19 nt, artificial
  Chemically synthesized
cuucacuacagagacuuua

SEQ ID NO: 5963 - RNA, 19 nt, artificial
  Chemically synthesized
guuugaauaucaccuguca

SEQ ID NO: 5964 - RNA, 19 nt, artificial
  Chemically synthesized
ggagcaguugucuccaaca

SEQ ID NO: 5965 - RNA, 19 nt, artificial
  Chemically synthesized
aagaauuccgauuagcaua

SEQ ID NO: 5966 - RNA, 19 nt, artificial
  Chemically synthesized
caauuugaccauugaagaa

SEQ ID NO: 5967 - RNA, 19 nt, artificial
  Chemically synthesized
cauuugaaauggaugucua

SEQ ID NO: 5968 - RNA, 19 nt, artificial
  Chemically synthesized
ccuaaggaaaccugauuaa

SEQ ID NO: 5969 - RNA, 19 nt, artificial
  Chemically synthesized
gccugugcugaguuugaau

SEQ ID NO: 5970 - RNA, 19 nt, artificial
  Chemically synthesized
ggaacccaugacaaagaaa

SEQ ID NO: 5971 - RNA, 19 nt, artificial
  Chemically synthesized
ggacaucucaaaacuuuga

SEQ ID NO: 5972 - RNA, 19 nt, artificial
  Chemically synthesized
gguucuuauaaagaagguu

SEQ ID NO: 5973 - RNA, 19 nt, artificial
  Chemically synthesized
gcaggucuagggugauuga

SEQ ID NO: 5974 - RNA, 19 nt, artificial
  Chemically synthesized
gaacuacgugugaagguau

SEQ ID NO: 5975 - RNA, 19 nt, artificial
  Chemically synthesized
gccuauaagcuaauaucau

SEQ ID NO: 5976 - RNA, 19 nt, artificial
  Chemically synthesized
ccauugaagaauuccgauu

SEQ ID NO: 5977 - RNA, 19 nt, artificial
  Chemically synthesized
gguuguuuaagacgugcuu

SEQ ID NO: 5978 - RNA, 19 nt, artificial
  Chemically synthesized
guauuuauugcacagacuu

SEQ ID NO: 5979 - RNA, 19 nt, artificial
  Chemically synthesized
ccucagugugcuuguagua

SEQ ID NO: 5980 - RNA, 19 nt, artificial
  Chemically synthesized
gacuauugaaaggguaaaa

SEQ ID NO: 5981 - RNA, 19 nt, artificial
  Chemically synthesized
cagaacaagugauguuuga

SEQ ID NO: 5982 - RNA, 19 nt, artificial
  Chemically synthesized
gcaguugucuccaacagca

SEQ ID NO: 5983 - RNA, 19 nt, artificial
  Chemically synthesized
ggaaugugcaacaccuuca

SEQ ID NO: 5984 - RNA, 19 nt, artificial
  Chemically synthesized
aguauuuauugcacagacu

SEQ ID NO: 5985 - RNA, 19 nt, artificial
  Chemically synthesized
ggcuagaggcaggaaggaa

SEQ ID NO: 5986 - RNA, 19 nt, artificial
  Chemically synthesized
ccagcauuccaauuugaaa

SEQ ID NO: 5987 - RNA, 19 nt, artificial
  Chemically synthesized
ucuucauuguccugcagaa

SEQ ID NO: 5988 - RNA, 19 nt, artificial
  Chemically synthesized
ggauuuccagcauuccaau

SEQ ID NO: 5989 - RNA, 19 nt, artificial
  Chemically synthesized
gaccuuuccagcaacaaga

SEQ ID NO: 5990 - RNA, 19 nt, artificial
  Chemically synthesized
agccuaagccaccucucua

SEQ ID NO: 5991 - RNA, 19 nt, artificial
  Chemically synthesized
ggcguuuucuucuucuaac

SEQ ID NO: 5992 - RNA, 19 nt, artificial
  Chemically synthesized
ccugugcugaguuugaaua

SEQ ID NO: 5993 - RNA, 19 nt, artificial
  Chemically synthesized
ccagcuggguccaacacuu

SEQ ID NO: 5994 - RNA, 19 nt, artificial
  Chemically synthesized
cugagucuuuugaauggaa

SEQ ID NO: 5995 - RNA, 19 nt, artificial
  Chemically synthesized
cucuuuagggagacacaga

SEQ ID NO: 5996 - RNA, 19 nt, artificial
  Chemically synthesized
cagugugcuuguaguaucu

SEQ ID NO: 5997 - RNA, 19 nt, artificial
  Chemically synthesized
cuuggaaaaguuugacaaa

SEQ ID NO: 5998 - RNA, 19 nt, artificial
  Chemically synthesized
gaagggagaaaugaggaaa

SEQ ID NO: 5999 - RNA, 19 nt, artificial
  Chemically synthesized
caaagguugcuguucucaa

SEQ ID NO: 6000 - RNA, 19 nt, artificial
  Chemically synthesized
ccucauuuaccuugacauu

SEQ ID NO: 6001 - RNA, 19 nt, artificial
  Chemically synthesized
cuaccucgaugauauuauu

SEQ ID NO: 6002 - RNA, 19 nt, artificial
  Chemically synthesized
gaaacaaaugagugaguuu

SEQ ID NO: 6003 - RNA, 19 nt, artificial
  Chemically synthesized
cuuugcuuguacuugugaa

SEQ ID NO: 6004 - RNA, 19 nt, artificial
  Chemically synthesized
ucuaguggcuaauuccuaa

SEQ ID NO: 6005 - RNA, 19 nt, artificial
  Chemically synthesized
gucuaguggcuaauuccua

SEQ ID NO: 6006 - RNA, 19 nt, artificial
  Chemically synthesized
gaccauugaagaauuccga

SEQ ID NO: 6007 - RNA, 19 nt, artificial
  Chemically synthesized
cuuuagaccugucccugaa

SEQ ID NO: 6008 - RNA, 19 nt, artificial
  Chemically synthesized
aguguuucagaguguguuu

SEQ ID NO: 6009 - RNA, 19 nt, artificial
  Chemically synthesized
gugugaaauccagacaauu

SEQ ID NO: 6010 - RNA, 19 nt, artificial
  Chemically synthesized
aucuagcaucucuagagaa

SEQ ID NO: 6011 - RNA, 19 nt, artificial
  Chemically synthesized
cuugauuccagaaacauau

SEQ ID NO: 6012 - RNA, 19 nt, artificial
  Chemically synthesized
gaguggauguuaucauuga

SEQ ID NO: 6013 - RNA, 19 nt, artificial
  Chemically synthesized
agggagaaaugaggaaaua

SEQ ID NO: 6014 - RNA, 19 nt, artificial
  Chemically synthesized
gagaugaguucucuacucu

SEQ ID NO: 6015 - RNA, 19 nt, artificial
  Chemically synthesized
cccauuggacaucucaaaa

SEQ ID NO: 6016 - RNA, 19 nt, artificial
  Chemically synthesized
gauuagcauacuuagacua

SEQ ID NO: 6017 - RNA, 19 nt, artificial
  Chemically synthesized
gguucuugauuacagucuc

SEQ ID NO: 6018 - RNA, 19 nt, artificial
  Chemically synthesized
aggugggcauuucaaccaa

SEQ ID NO: 6019 - RNA, 19 nt, artificial
  Chemically synthesized
gcagcagaaguuuauuuuu

SEQ ID NO: 6020 - RNA, 19 nt, artificial
  Chemically synthesized
caggagaacuacgugugaa

SEQ ID NO: 6021 - RNA, 19 nt, artificial
  Chemically synthesized
ggcuguguguauuugaaag

SEQ ID NO: 6022 - RNA, 19 nt, artificial
  Chemically synthesized
accucucuaccuuaauauu

SEQ ID NO: 6023 - RNA, 19 nt, artificial
  Chemically synthesized
guagucuagcuuucuuaaa

SEQ ID NO: 6024 - RNA, 19 nt, artificial
  Chemically synthesized
ccagucucgaagucuugaa

SEQ ID NO: 6025 - RNA, 19 nt, artificial
  Chemically synthesized
cuggucuuaucauggacaa

SEQ ID NO: 6026 - RNA, 19 nt, artificial
  Chemically synthesized
cucagaaacagaacauuca

SEQ ID NO: 6027 - RNA, 19 nt, artificial
  Chemically synthesized
caaaaguccagaaugcuaa

SEQ ID NO: 6028 - RNA, 19 nt, artificial
  Chemically synthesized
caggcguuuucuucuucua

SEQ ID NO: 6029 - RNA, 19 nt, artificial
  Chemically synthesized
guuaaagucuaguggcuaa

SEQ ID NO: 6030 - RNA, 19 nt, artificial
  Chemically synthesized
uggcuaauuccuaaggaaa

SEQ ID NO: 6031 - RNA, 19 nt, artificial
  Chemically synthesized
gcuguuugagaugaguucu

SEQ ID NO: 6032 - RNA, 19 nt, artificial
  Chemically synthesized
gcggguucuacaucaaaug

SEQ ID NO: 6033 - RNA, 19 nt, artificial
  Chemically synthesized
guuuaagacgugcuucaaa

SEQ ID NO: 6034 - RNA, 19 nt, artificial
  Chemically synthesized
gguguguuuccaugucuca

SEQ ID NO: 6035 - RNA, 19 nt, artificial
  Chemically synthesized
gacuaucaaguuuacagaa

SEQ ID NO: 6036 - RNA, 19 nt, artificial
  Chemically synthesized
cuugaagaauacauccauu

SEQ ID NO: 6037 - RNA, 19 nt, artificial
  Chemically synthesized
aguagaaauggcuugaguu

SEQ ID NO: 6038 - RNA, 19 nt, artificial
  Chemically synthesized
cacagacuugcggguucua

SEQ ID NO: 6039 - RNA, 19 nt, artificial
  Chemically synthesized
cagagaaaacagaaagaga

SEQ ID NO: 6040 - RNA, 19 nt, artificial
  Chemically synthesized
ugcuuugaauacaccaauu

SEQ ID NO: 6041 - RNA, 19 nt, artificial
  Chemically synthesized
ggaagagaagacaccagug

SEQ ID NO: 6042 - RNA, 19 nt, artificial
  Chemically synthesized
ccaaaaaacaggaacuaca

SEQ ID NO: 6043 - RNA, 19 nt, artificial
  Chemically synthesized
agggaguugucuaauuggu

SEQ ID NO: 6044 - RNA, 19 nt, artificial
  Chemically synthesized
gaaacagaacauucaagaa

SEQ ID NO: 6045 - RNA, 19 nt, artificial
  Chemically synthesized
cuuccucuccugugacaaa

SEQ ID NO: 6046 - RNA, 19 nt, artificial
  Chemically synthesized
acuugcggguucuacauca

SEQ ID NO: 6047 - RNA, 19 nt, artificial
  Chemically synthesized
ggguaaggaaugagcuagu

SEQ ID NO: 6048 - RNA, 19 nt, artificial
  Chemically synthesized
aguaaugacugucaugaaa

SEQ ID NO: 6049 - RNA, 19 nt, artificial
  Chemically synthesized
agggcuguguguauuugaa

SEQ ID NO: 6050 - RNA, 19 nt, artificial
  Chemically synthesized
ggguguucacuuuuuccuu

SEQ ID NO: 6051 - RNA, 19 nt, artificial
  Chemically synthesized
cagucucgaagucuugaaa

SEQ ID NO: 6052 - RNA, 19 nt, artificial
  Chemically synthesized
ggaaaaggaggaagggaga

SEQ ID NO: 6053 - RNA, 19 nt, artificial
  Chemically synthesized
agccuuuucuggacuauca

SEQ ID NO: 6054 - RNA, 19 nt, artificial
  Chemically synthesized
cuaacuuccucuccuguga

SEQ ID NO: 6055 - RNA, 19 nt, artificial
  Chemically synthesized
ugucuauggcuguuugaga

SEQ ID NO: 6056 - RNA, 19 nt, artificial
  Chemically synthesized
gagaaacaaaaguccagaa

SEQ ID NO: 6057 - RNA, 19 nt, artificial
  Chemically synthesized
gaccacagucagaaguguu

SEQ ID NO: 6058 - RNA, 19 nt, artificial
  Chemically synthesized
gacagagaaaacagaaaga

SEQ ID NO: 6059 - RNA, 19 nt, artificial
  Chemically synthesized
gccacugcugcucacagaa

SEQ ID NO: 6060 - RNA, 19 nt, artificial
  Chemically synthesized
gaagaauacauccauuuga

SEQ ID NO: 6061 - RNA, 19 nt, artificial
  Chemically synthesized
ccugauuaacacaugcuca

SEQ ID NO: 6062 - RNA, 19 nt, artificial
  Chemically synthesized
cccuggugagugugacuau

SEQ ID NO: 6063 - RNA, 19 nt, artificial
  Chemically synthesized
aagacagagaaaacagaaa

SEQ ID NO: 6064 - RNA, 19 nt, artificial
  Chemically synthesized
uggauguuaucauugagaa

SEQ ID NO: 6065 - RNA, 19 nt, artificial
  Chemically synthesized
caccagaguuuccugcaau

SEQ ID NO: 6066 - RNA, 19 nt, artificial
  Chemically synthesized
cuccugcgugagaccagaa

SEQ ID NO: 6067 - RNA, 19 nt, artificial
  Chemically synthesized
ugugcaacaccuucagaua

SEQ ID NO: 6068 - RNA, 19 nt, artificial
  Chemically synthesized
ccagucuucagguacuaaa

SEQ ID NO: 6069 - RNA, 19 nt, artificial
  Chemically synthesized
ggcuucauaagcugacuuu

SEQ ID NO: 6070 - RNA, 19 nt, artificial
  Chemically synthesized
accuuaauauugacaggaa

SEQ ID NO: 6071 - RNA, 19 nt, artificial
  Chemically synthesized
cgauuagcauacuuagacu

SEQ ID NO: 6072 - RNA, 19 nt, artificial
  Chemically synthesized
ccaacacuuguucaguuaa

SEQ ID NO: 6073 - RNA, 19 nt, artificial
  Chemically synthesized
gaaaacagaaagagacauu

SEQ ID NO: 6074 - RNA, 19 nt, artificial
  Chemically synthesized
ggcuaauuccuaaggaaac

SEQ ID NO: 6075 - RNA, 19 nt, artificial
  Chemically synthesized
ggguucuuauaaagaaggu

SEQ ID NO: 6076 - RNA, 19 nt, artificial
  Chemically synthesized
cuagcaucucuagagaacu

SEQ ID NO: 6077 - RNA, 19 nt, artificial
  Chemically synthesized
guucuuuuccugagucuuu

SEQ ID NO: 6078 - RNA, 19 nt, artificial
  Chemically synthesized
acuucuugggcuuagaaca

SEQ ID NO: 6079 - RNA, 19 nt, artificial
  Chemically synthesized
aagccaccucucuaccuua

SEQ ID NO: 6080 - RNA, 19 nt, artificial
  Chemically synthesized
gguguucacuuuuuccuuu

SEQ ID NO: 6081 - RNA, 19 nt, artificial
  Chemically synthesized
caaccaacucagucaagga

SEQ ID NO: 6082 - RNA, 19 nt, artificial
  Chemically synthesized
ggagaauuuagaaaugaag

SEQ ID NO: 6083 - RNA, 19 nt, artificial
  Chemically synthesized
aggcguuuucuucuucuaa

SEQ ID NO: 6084 - RNA, 19 nt, artificial
  Chemically synthesized
ggaaaaguuugacaaaucu

SEQ ID NO: 6085 - RNA, 19 nt, artificial
  Chemically synthesized
ugaguuucuagaucucagu

SEQ ID NO: 6086 - RNA, 19 nt, artificial
  Chemically synthesized
ucucgagcauguucuauuu

SEQ ID NO: 6087 - RNA, 19 nt, artificial
  Chemically synthesized
uguccagucucgaagucuu

SEQ ID NO: 6088 - RNA, 19 nt, artificial
  Chemically synthesized
ugcuguucucaaagugauu

SEQ ID NO: 6089 - RNA, 19 nt, artificial
  Chemically synthesized
guggguacaggaugcaauu

SEQ ID NO: 6090 - RNA, 19 nt, artificial
  Chemically synthesized
gcucuugguggaaguugaa

SEQ ID NO: 6091 - RNA, 19 nt, artificial
  Chemically synthesized
ggaugucuauggcuguuug

SEQ ID NO: 6092 - RNA, 19 nt, artificial
  Chemically synthesized
acaguuucccacauugaaa

SEQ ID NO: 6093 - RNA, 19 nt, artificial
  Chemically synthesized
ccugcuggaugguaaauca

SEQ ID NO: 6094 - RNA, 19 nt, artificial
  Chemically synthesized
guucuggucuauaaguucu

SEQ ID NO: 6095 - RNA, 19 nt, artificial
  Chemically synthesized
ggaacaguggguacaggau

SEQ ID NO: 6096 - RNA, 19 nt, artificial
  Chemically synthesized
gagccgcugguguaucuuu

SEQ ID NO: 6097 - RNA, 19 nt, artificial
  Chemically synthesized
ugagugaguuuucaguauu

SEQ ID NO: 6098 - RNA, 19 nt, artificial
  Chemically synthesized
caaguagucuagcuuucuu

SEQ ID NO: 6099 - RNA, 19 nt, artificial
  Chemically synthesized
guuauuaccaugaguucaa

SEQ ID NO: 6100 - RNA, 19 nt, artificial
  Chemically synthesized
gaaacauaugggcugauaa

SEQ ID NO: 6101 - RNA, 19 nt, artificial
  Chemically synthesized
agacuaaaauacagagucu

SEQ ID NO: 6102 - RNA, 19 nt, artificial
  Chemically synthesized
guuauugccuacuaaguaa

SEQ ID NO: 6103 - RNA, 19 nt, artificial
  Chemically synthesized
gacaccagugccucagaaa

SEQ ID NO: 6104 - RNA, 19 nt, artificial
  Chemically synthesized
guucaaacuucuugggcuu

SEQ ID NO: 6105 - RNA, 19 nt, artificial
  Chemically synthesized
ggaugguaaaucauggaau

SEQ ID NO: 6106 - RNA, 19 nt, artificial
  Chemically synthesized
uggugagugugacuauuga

SEQ ID NO: 6107 - RNA, 19 nt, artificial
  Chemically synthesized
agcaacaucuaucugaaga

SEQ ID NO: 6108 - RNA, 19 nt, artificial
  Chemically synthesized
gaguuucaaagguugcugu

SEQ ID NO: 6109 - RNA, 19 nt, artificial
  Chemically synthesized
gguguuauuaccaugaguu

SEQ ID NO: 6110 - RNA, 19 nt, artificial
  Chemically synthesized
ugcagaagguggagaagac

SEQ ID NO: 6111 - RNA, 19 nt, artificial
  Chemically synthesized
cugcagaagguggagaaga

SEQ ID NO: 6112 - RNA, 19 nt, artificial
  Chemically synthesized
gaaucucuuuagggagaca

SEQ ID NO: 6113 - RNA, 19 nt, artificial
  Chemically synthesized
gccuucacuacagagacuu

SEQ ID NO: 6114 - RNA, 19 nt, artificial
  Chemically synthesized
gaguauacauugcuguuuc

SEQ ID NO: 6115 - RNA, 19 nt, artificial
  Chemically synthesized
gcauuucaaccaacucagu

SEQ ID NO: 6116 - RNA, 19 nt, artificial
  Chemically synthesized
cugguaucaucuucauugu

SEQ ID NO: 6117 - RNA, 19 nt, artificial
  Chemically synthesized
ugucucauguacuagugaa

SEQ ID NO: 6118 - RNA, 19 nt, artificial
  Chemically synthesized
agauaugcagggcugcuaa

SEQ ID NO: 6119 - RNA, 19 nt, artificial
  Chemically synthesized
gaugaguucucuacucuug

SEQ ID NO: 6120 - RNA, 19 nt, artificial
  Chemically synthesized
uauagaagagagugugauu

SEQ ID NO: 6121 - RNA, 19 nt, artificial
  Chemically synthesized
ugaacuggguguucacuuu

SEQ ID NO: 6122 - RNA, 19 nt, artificial
  Chemically synthesized
gguauucaaggcagggagu

SEQ ID NO: 6123 - RNA, 19 nt, artificial
  Chemically synthesized
gggugaguaauuccauggu

SEQ ID NO: 6124 - RNA, 19 nt, artificial
  Chemically synthesized
cagaguuuccugcaaugga

SEQ ID NO: 6125 - RNA, 19 nt, artificial
  Chemically synthesized
cuuagaacaacuagaacau

SEQ ID NO: 6126 - RNA, 19 nt, artificial
  Chemically synthesized
uucuagaucucaguagaaa

SEQ ID NO: 6127 - RNA, 19 nt, artificial
  Chemically synthesized
uuucuagaucucaguagaa

SEQ ID NO: 6128 - RNA, 19 nt, artificial
  Chemically synthesized
ccaugaguucaaacuucuu

SEQ ID NO: 6129 - RNA, 19 nt, artificial
  Chemically synthesized
ggugaaaacaucuaugaug

SEQ ID NO: 6130 - RNA, 19 nt, artificial
  Chemically synthesized
cuugugaacaccagaguuu

SEQ ID NO: 6131 - RNA, 19 nt, artificial
  Chemically synthesized
cuaagggugaguaauucca

SEQ ID NO: 6132 - RNA, 19 nt, artificial
  Chemically synthesized
caaccauccuggucauucu

SEQ ID NO: 6133 - RNA, 19 nt, artificial
  Chemically synthesized
uguggagacaaaucuagca

SEQ ID NO: 6134 - RNA, 19 nt, artificial
  Chemically synthesized
aguugaauaaagacagaga

SEQ ID NO: 6135 - RNA, 19 nt, artificial
  Chemically synthesized
acaccagaguugcuuucaa

SEQ ID NO: 6136 - RNA, 19 nt, artificial
  Chemically synthesized
agaguugcuuucaauggca

SEQ ID NO: 6137 - RNA, 19 nt, artificial
  Chemically synthesized
gcaugccugugcugaguuu

SEQ ID NO: 6138 - RNA, 19 nt, artificial
  Chemically synthesized
cuuaccucaucaaguugaa

SEQ ID NO: 6139 - RNA, 19 nt, artificial
  Chemically synthesized
gaguuugaauaucaccugu

SEQ ID NO: 6140 - RNA, 19 nt, artificial
  Chemically synthesized
aaguagucuagcuuucuua

SEQ ID NO: 6141 - RNA, 19 nt, artificial
  Chemically synthesized
aggugugaaauccagacaa

SEQ ID NO: 6142 - RNA, 19 nt, artificial
  Chemically synthesized
cuggguaaggaaugagcua

SEQ ID NO: 6143 - RNA, 19 nt, artificial
  Chemically synthesized
cuuacuuucacuuccaaca

SEQ ID NO: 6144 - RNA, 19 nt, artificial
  Chemically synthesized
gcucagaccuggcaguuuc

SEQ ID NO: 6145 - RNA, 19 nt, artificial
  Chemically synthesized
cauugaaacucaaaucucu

SEQ ID NO: 6146 - RNA, 19 nt, artificial
  Chemically synthesized
cacuauuuuucaaggaagu

SEQ ID NO: 6147 - RNA, 19 nt, artificial
  Chemically synthesized
ggcagcucuugguggaagu

SEQ ID NO: 6148 - RNA, 19 nt, artificial
  Chemically synthesized
cacccuuuagcccagaacu

SEQ ID NO: 6149 - RNA, 19 nt, artificial
  Chemically synthesized
cugucaugaaagcagcauu

SEQ ID NO: 6150 - RNA, 19 nt, artificial
  Chemically synthesized
uuguagcaguucuggucua

SEQ ID NO: 6151 - RNA, 19 nt, artificial
  Chemically synthesized
accacagucagaaguguuu

SEQ ID NO: 6152 - RNA, 19 nt, artificial
  Chemically synthesized
gcauuuaacucacucucca

SEQ ID NO: 6153 - RNA, 19 nt, artificial
  Chemically synthesized
ccuuauaagugucugaacu

SEQ ID NO: 6154 - RNA, 19 nt, artificial
  Chemically synthesized
caguagaaauggcuugagu

SEQ ID NO: 6155 - RNA, 19 nt, artificial
  Chemically synthesized
aggcuuacuuucacuucca

SEQ ID NO: 6156 - RNA, 19 nt, artificial
  Chemically synthesized
guaucaucuucauuguccu

SEQ ID NO: 6157 - RNA, 19 nt, artificial
  Chemically synthesized
gucagaugaauaagaccau

SEQ ID NO: 6158 - RNA, 19 nt, artificial
  Chemically synthesized
guccaacacuuguucaguu

SEQ ID NO: 6159 - RNA, 19 nt, artificial
  Chemically synthesized
caacaaaauucaguuguca

SEQ ID NO: 6160 - RNA, 19 nt, artificial
  Chemically synthesized
agcccagaacugcuuugaa

SEQ ID NO: 6161 - RNA, 19 nt, artificial
  Chemically synthesized
cucacaccagaguugcuuu

SEQ ID NO: 6162 - RNA, 19 nt, artificial
  Chemically synthesized
cugguggcuguggagacaa

SEQ ID NO: 6163 - RNA, 19 nt, artificial
  Chemically synthesized
cucagaaacugcucgguca

SEQ ID NO: 6164 - RNA, 19 nt, artificial
  Chemically synthesized
ggguguguuuccaugucuc

SEQ ID NO: 6165 - RNA, 19 nt, artificial
  Chemically synthesized
gucaaaacuggaaauauga

SEQ ID NO: 6166 - RNA, 19 nt, artificial
  Chemically synthesized
ucuugauuccagaaacaua

SEQ ID NO: 6167 - RNA, 19 nt, artificial
  Chemically synthesized
guucugggagaauuuagaa

SEQ ID NO: 6168 - RNA, 19 nt, artificial
  Chemically synthesized
agcccugcuggaugguaaa

SEQ ID NO: 6169 - RNA, 19 nt, artificial
  Chemically synthesized
cuccugugacaaaagagau

SEQ ID NO: 6170 - RNA, 19 nt, artificial
  Chemically synthesized
aguucuauuuucaccugau

SEQ ID NO: 6171 - RNA, 19 nt, artificial
  Chemically synthesized
ggaggaagggagaaaugag

SEQ ID NO: 6172 - RNA, 19 nt, artificial
  Chemically synthesized
uacuuucacuuccaacaaa

SEQ ID NO: 6173 - RNA, 19 nt, artificial
  Chemically synthesized
cugaaucucuuuagggaga

SEQ ID NO: 6174 - RNA, 19 nt, artificial
  Chemically synthesized
gcuuguccagucucgaagu

SEQ ID NO: 6175 - RNA, 19 nt, artificial
  Chemically synthesized
gagugaguuuucaguauuc

SEQ ID NO: 6176 - RNA, 19 nt, artificial
  Chemically synthesized
gugcaauuugaccauugaa

SEQ ID NO: 6177 - RNA, 19 nt, artificial
  Chemically synthesized
ugaaauccagacaauugaa

SEQ ID NO: 6178 - RNA, 19 nt, artificial
  Chemically synthesized
ugguggaaguugaacgaau

SEQ ID NO: 6179 - RNA, 19 nt, artificial
  Chemically synthesized
cauuucaacucuuaccuca

SEQ ID NO: 6180 - RNA, 19 nt, artificial
  Chemically synthesized
caccucucuaccuuaauau

SEQ ID NO: 6181 - RNA, 19 nt, artificial
  Chemically synthesized
agacaccagugccucagaa

SEQ ID NO: 6182 - RNA, 19 nt, artificial
  Chemically synthesized
ggugauagcgagccacgca

SEQ ID NO: 6183 - RNA, 19 nt, artificial
  Chemically synthesized
ccugcguggaggugugaaa

SEQ ID NO: 6184 - RNA, 19 nt, artificial
  Chemically synthesized
cucugaaucucuuuaggga

SEQ ID NO: 6185 - RNA, 19 nt, artificial
  Chemically synthesized
auagaagagagugugauua

SEQ ID NO: 6186 - RNA, 19 nt, artificial
  Chemically synthesized
caucuaugaugccuuuguu

SEQ ID NO: 6187 - RNA, 19 nt, artificial
  Chemically synthesized
guggagacaaaucuagcau

SEQ ID NO: 6188 - RNA, 19 nt, artificial
  Chemically synthesized
ccgcaugaucauaucugua

SEQ ID NO: 6189 - RNA, 19 nt, artificial
  Chemically synthesized
caguugucaaaacuggaaa

SEQ ID NO: 6190 - RNA, 19 nt, artificial
  Chemically synthesized
uucacuacagagacuuuau

SEQ ID NO: 6191 - RNA, 19 nt, artificial
  Chemically synthesized
uccugugacaaaagagaua

SEQ ID NO: 6192 - RNA, 19 nt, artificial
  Chemically synthesized
aacuuaauguggcucacaa

SEQ ID NO: 6193 - RNA, 19 nt, artificial
  Chemically synthesized
agaaagagacauuguucuu

SEQ ID NO: 6194 - RNA, 19 nt, artificial
  Chemically synthesized
cuauggcuguuugagauga

SEQ ID NO: 6195 - RNA, 19 nt, artificial
  Chemically synthesized
cucuacucuugugcuugua

SEQ ID NO: 6196 - RNA, 19 nt, artificial
  Chemically synthesized
gcagcauugaaauaauuug

SEQ ID NO: 6197 - RNA, 19 nt, artificial
  Chemically synthesized
aaaguaugguagaggugaa

SEQ ID NO: 6198 - RNA, 19 nt, artificial
  Chemically synthesized
gggagccuuuucuggacua

SEQ ID NO: 6199 - RNA, 19 nt, artificial
  Chemically synthesized
acuuaauguggcucacaau

SEQ ID NO: 6200 - RNA, 19 nt, artificial
  Chemically synthesized
caggaugaggacuggguaa

SEQ ID NO: 6201 - RNA, 19 nt, artificial
  Chemically synthesized
uuaugcuaagggugaguaa

SEQ ID NO: 6202 - RNA, 19 nt, artificial
  Chemically synthesized
cugguguaucuuugaauau

SEQ ID NO: 6203 - RNA, 19 nt, artificial
  Chemically synthesized
acuacuaccucgaugauau

SEQ ID NO: 6204 - RNA, 19 nt, artificial
  Chemically synthesized
gccaccucucuaccuuaau

SEQ ID NO: 6205 - RNA, 19 nt, artificial
  Chemically synthesized
ccugaacccuaugaacuuu

SEQ ID NO: 6206 - RNA, 19 nt, artificial
  Chemically synthesized
uaugcuaagggugaguaau

SEQ ID NO: 6207 - RNA, 19 nt, artificial
  Chemically synthesized
ggauacguuuccuuauaag

SEQ ID NO: 6208 - RNA, 19 nt, artificial
  Chemically synthesized
accaagccuugaguuucua

SEQ ID NO: 6209 - RNA, 19 nt, artificial
  Chemically synthesized
cauugagaaaacaaugugu

SEQ ID NO: 6210 - RNA, 19 nt, artificial
  Chemically synthesized
uguagcaguucuggucuau

SEQ ID NO: 6211 - RNA, 19 nt, artificial
  Chemically synthesized
gucuucagguacuaaauau

SEQ ID NO: 6212 - RNA, 19 nt, artificial
  Chemically synthesized
uagcaucucuagagaacuu

SEQ ID NO: 6213 - RNA, 19 nt, artificial
  Chemically synthesized
guguguccgcaugaucaua

SEQ ID NO: 6214 - RNA, 19 nt, artificial
  Chemically synthesized
ucuugauuacagucucaau

SEQ ID NO: 6215 - RNA, 19 nt, artificial
  Chemically synthesized
guguguguccgcaugauca

SEQ ID NO: 6216 - RNA, 19 nt, artificial
  Chemically synthesized
ccaugacaaagaaagucau

SEQ ID NO: 6217 - RNA, 19 nt, artificial
  Chemically synthesized
ccuacuaaguaaugacugu

SEQ ID NO: 6218 - RNA, 19 nt, artificial
  Chemically synthesized
agaugaauaagaccaucau

SEQ ID NO: 6219 - RNA, 19 nt, artificial
  Chemically synthesized
ggugggcauuucaaccaac

SEQ ID NO: 6220 - RNA, 19 nt, artificial
  Chemically synthesized
caggugcauuuaaagaaau

SEQ ID NO: 6221 - RNA, 19 nt, artificial
  Chemically synthesized
gagacuuuauucccggugu

SEQ ID NO: 6222 - RNA, 19 nt, artificial
  Chemically synthesized
gacauuucucauacucaca

SEQ ID NO: 6223 - RNA, 19 nt, artificial
  Chemically synthesized
gaaugagcuaguaaagaau

SEQ ID NO: 6224 - RNA, 19 nt, artificial
  Chemically synthesized
ccuugaguuucuagaucuc

SEQ ID NO: 6225 - RNA, 19 nt, artificial
  Chemically synthesized
ucuggagacgacucagaaa

SEQ ID NO: 6226 - RNA, 19 nt, artificial
  Chemically synthesized
agcugagaaacuugaccuu

SEQ ID NO: 6227 - RNA, 19 nt, artificial
  Chemically synthesized
agaagacaccagugccuca

SEQ ID NO: 6228 - RNA, 19 nt, artificial
  Chemically synthesized
ugaguuuucaguauuccua

SEQ ID NO: 6229 - RNA, 19 nt, artificial
  Chemically synthesized
cuccagucuucagguacua

SEQ ID NO: 6230 - RNA, 19 nt, artificial
  Chemically synthesized
ucaaggucuggcugguuua

SEQ ID NO: 6231 - RNA, 19 nt, artificial
  Chemically synthesized
cuuaugcuaagggugagua

SEQ ID NO: 6232 - RNA, 19 nt, artificial
  Chemically synthesized
agaacauucaagaaaagga

SEQ ID NO: 6233 - RNA, 19 nt, artificial
  Chemically synthesized
cccagaaaagaauguucau

SEQ ID NO: 6234 - RNA, 19 nt, artificial
  Chemically synthesized
cuuccaggugggcauuuca

SEQ ID NO: 6235 - RNA, 19 nt, artificial
  Chemically synthesized
ccuugacauuucucauacu

SEQ ID NO: 6236 - RNA, 19 nt, artificial
  Chemically synthesized
uacagucucaaucacauaa

SEQ ID NO: 6237 - RNA, 19 nt, artificial
  Chemically synthesized
guugcuguucucaaaguga

SEQ ID NO: 6238 - RNA, 19 nt, artificial
  Chemically synthesized
ggcauuucaaccaacucag

SEQ ID NO: 6239 - RNA, 19 nt, artificial
  Chemically synthesized
cgaggaagagaagacacca

SEQ ID NO: 6240 - RNA, 19 nt, artificial
  Chemically synthesized
ggaaaaguacacucuguca

SEQ ID NO: 6241 - RNA, 19 nt, artificial
  Chemically synthesized
caucuaucugaagaggaaa

SEQ ID NO: 6242 - RNA, 19 nt, artificial
  Chemically synthesized
gcuguggagacaaaucuag

SEQ ID NO: 6243 - RNA, 19 nt, artificial
  Chemically synthesized
cagucucaaucacauaaug

SEQ ID NO: 6244 - RNA, 19 nt, artificial
  Chemically synthesized
uagaagagagugugauuau

SEQ ID NO: 6245 - RNA, 19 nt, artificial
  Chemically synthesized
uguauagaagagaguguga

SEQ ID NO: 6246 - RNA, 19 nt, artificial
  Chemically synthesized
ccuuaugcuaagggugagu

SEQ ID NO: 6247 - RNA, 19 nt, artificial
  Chemically synthesized
cugccaacaucauccauga

SEQ ID NO: 6248 - RNA, 19 nt, artificial
  Chemically synthesized
cuaucagggcuguguguau

SEQ ID NO: 6249 - RNA, 19 nt, artificial
  Chemically synthesized
gaguugcuuucaauggcau

SEQ ID NO: 6250 - RNA, 19 nt, artificial
  Chemically synthesized
cuggucuauaaguucuauu

SEQ ID NO: 6251 - RNA, 19 nt, artificial
  Chemically synthesized
aguaucuguuguagcaguu

SEQ ID NO: 6252 - RNA, 19 nt, artificial
  Chemically synthesized
cugugcugaguuugaauau

SEQ ID NO: 6253 - RNA, 19 nt, artificial
  Chemically synthesized
caguauuccuaucacucag

SEQ ID NO: 6254 - RNA, 19 nt, artificial
  Chemically synthesized
ccauccuggucauucucga

SEQ ID NO: 6255 - RNA, 19 nt, artificial
  Chemically synthesized
ggucauucucgagcauguu

SEQ ID NO: 6256 - RNA, 19 nt, artificial
  Chemically synthesized
cagaguguguuugguuuga

SEQ ID NO: 6257 - RNA, 19 nt, artificial
  Chemically synthesized
gaguguuucagaguguguu

SEQ ID NO: 6258 - RNA, 19 nt, artificial
  Chemically synthesized
agaagacccugcucaggca

SEQ ID NO: 6259 - RNA, 19 nt, artificial
  Chemically synthesized
ugggaaugcuuuuucagaa

SEQ ID NO: 6260 - RNA, 19 nt, artificial
  Chemically synthesized
gggugaccucaugaaauga

SEQ ID NO: 6261 - RNA, 19 nt, artificial
  Chemically synthesized
gcucgaggaagagaagaca

SEQ ID NO: 6262 - RNA, 19 nt, artificial
  Chemically synthesized
auuucaaccaacucaguca

SEQ ID NO: 6263 - RNA, 19 nt, artificial
  Chemically synthesized
ucuucacagagcugagaaa

SEQ ID NO: 6264 - RNA, 19 nt, artificial
  Chemically synthesized
gaggugaaaacaucuauga

SEQ ID NO: 6265 - RNA, 19 nt, artificial
  Chemically synthesized
gguuuccauaaaagccgaa

SEQ ID NO: 6266 - RNA, 19 nt, artificial
  Chemically synthesized
cucagaccuggcaguuucu

SEQ ID NO: 6267 - RNA, 19 nt, artificial
  Chemically synthesized
cagaaagagacauuguucu

SEQ ID NO: 6268 - RNA, 19 nt, artificial
  Chemically synthesized
gagcuucaaugguguuauu

SEQ ID NO: 6269 - RNA, 19 nt, artificial
  Chemically synthesized
gagacauuguucuuuuccu

SEQ ID NO: 6270 - RNA, 19 nt, artificial
  Chemically synthesized
aagccuugaguuucuagau

SEQ ID NO: 6271 - RNA, 19 nt, artificial
  Chemically synthesized
agaaaagaauguucaucca

SEQ ID NO: 6272 - RNA, 19 nt, artificial
  Chemically synthesized
ugggcuuagaacaacuaga

SEQ ID NO: 6273 - RNA, 19 nt, artificial
  Chemically synthesized
gccugugcaauuugaccau

SEQ ID NO: 6274 - RNA, 19 nt, artificial
  Chemically synthesized
cagaugaauaagaccauca

SEQ ID NO: 6275 - RNA, 19 nt, artificial
  Chemically synthesized
cuuugucacucgaugucau

SEQ ID NO: 6276 - RNA, 19 nt, artificial
  Chemically synthesized
ccagaaacauaugggcuga

SEQ ID NO: 6277 - RNA, 19 nt, artificial
  Chemically synthesized
uagccaucauaaaaccauu

SEQ ID NO: 6278 - RNA, 19 nt, artificial
  Chemically synthesized
ccuuuucuugauuccagaa

SEQ ID NO: 6279 - RNA, 19 nt, artificial
  Chemically synthesized
agucucgaagucuugaaaa

SEQ ID NO: 6280 - RNA, 19 nt, artificial
  Chemically synthesized
guauagaagagagugugau

SEQ ID NO: 6281 - RNA, 19 nt, artificial
  Chemically synthesized
gaaacuuggaaaaguuuga

SEQ ID NO: 6282 - RNA, 19 nt, artificial
  Chemically synthesized
aucucuuuagggagacaca

SEQ ID NO: 6283 - RNA, 19 nt, artificial
  Chemically synthesized
uaaggaaugagcuaguaaa

SEQ ID NO: 6284 - RNA, 19 nt, artificial
  Chemically synthesized
uccugcagaagguggagaa

SEQ ID NO: 6285 - RNA, 19 nt, artificial
  Chemically synthesized
gucuagcuuucuuaaaucu

SEQ ID NO: 6286 - RNA, 19 nt, artificial
  Chemically synthesized
uggcuuguccagucucgaa

SEQ ID NO: 6287 - RNA, 19 nt, artificial
  Chemically synthesized
aguguuuguuacugagugu

SEQ ID NO: 6288 - RNA, 19 nt, artificial
  Chemically synthesized
cucauuuaccuugacauuu

SEQ ID NO: 6289 - RNA, 19 nt, artificial
  Chemically synthesized
guucucuacucuugugcuu

SEQ ID NO: 6290 - RNA, 19 nt, artificial
  Chemically synthesized
gccuuaugcuaagggugag

SEQ ID NO: 6291 - RNA, 19 nt, artificial
  Chemically synthesized
gucuagggugauugaacau

SEQ ID NO: 6292 - RNA, 19 nt, artificial
  Chemically synthesized
ugucugaaugaagcuauaa

SEQ ID NO: 6293 - RNA, 19 nt, artificial
  Chemically synthesized
cuuccagugcagagggaau

SEQ ID NO: 6294 - RNA, 19 nt, artificial
  Chemically synthesized
guacuaaauaugagccaca

SEQ ID NO: 6295 - RNA, 19 nt, artificial
  Chemically synthesized
cagaacugcuuugaauaca

SEQ ID NO: 6296 - RNA, 19 nt, artificial
  Chemically synthesized
cuugaguuucuagaucuca

SEQ ID NO: 6297 - RNA, 19 nt, artificial
  Chemically synthesized
aguugcagcagaaguuuau

SEQ ID NO: 6298 - RNA, 19 nt, artificial
  Chemically synthesized
cugcuuugaauacaccaau

SEQ ID NO: 6299 - RNA, 19 nt, artificial
  Chemically synthesized
cuuccaacaaaggugggaa

SEQ ID NO: 6300 - RNA, 19 nt, artificial
  Chemically synthesized
caaggcagggaguauacau

SEQ ID NO: 6301 - RNA, 19 nt, artificial
  Chemically synthesized
uccaugaagguuuccauaa

SEQ ID NO: 6302 - RNA, 19 nt, artificial
  Chemically synthesized
gcuguucucaaagugauuu

SEQ ID NO: 6303 - RNA, 19 nt, artificial
  Chemically synthesized
aucugaccaaucuagagca

SEQ ID NO: 6304 - RNA, 19 nt, artificial
  Chemically synthesized
cuaucacucagaaaccuca

SEQ ID NO: 6305 - RNA, 19 nt, artificial
  Chemically synthesized
guggcuguggagacaaauc

SEQ ID NO: 6306 - RNA, 19 nt, artificial
  Chemically synthesized
auuacagucucaaucacau

SEQ ID NO: 6307 - RNA, 19 nt, artificial
  Chemically synthesized
ugaagaauuccgauuagca

SEQ ID NO: 6308 - RNA, 19 nt, artificial
  Chemically synthesized
ggaacuacagcauuuucca

SEQ ID NO: 6309 - RNA, 19 nt, artificial
  Chemically synthesized
caaacuucuugggcuuaga

SEQ ID NO: 6310 - RNA, 19 nt, artificial
  Chemically synthesized
guggagaagacccugcuca

SEQ ID NO: 6311 - RNA, 19 nt, artificial
  Chemically synthesized
agguuuccauaaaagccga

SEQ ID NO: 6312 - RNA, 19 nt, artificial
  Chemically synthesized
ugccuauaagcuaauauca

SEQ ID NO: 6313 - RNA, 19 nt, artificial
  Chemically synthesized
cuacucuugugcuuguaca

SEQ ID NO: 6314 - RNA, 19 nt, artificial
  Chemically synthesized
gaauaaagacagagaaaac

SEQ ID NO: 6315 - RNA, 19 nt, artificial
  Chemically synthesized
ggacucugaucccagccau

SEQ ID NO: 6316 - RNA, 19 nt, artificial
  Chemically synthesized
cuggagcaguugucuccaa

SEQ ID NO: 6317 - RNA, 19 nt, artificial
  Chemically synthesized
gugcuucaaauauccauau

SEQ ID NO: 6318 - RNA, 19 nt, artificial
  Chemically synthesized
aggacuggguaaggaauga

SEQ ID NO: 6319 - RNA, 19 nt, artificial
  Chemically synthesized
gaccugucccugaacccua

SEQ ID NO: 6320 - RNA, 19 nt, artificial
  Chemically synthesized
augaguugcagcagaaguu

SEQ ID NO: 6321 - RNA, 19 nt, artificial
  Chemically synthesized
acaccagaguuuccugcaa

SEQ ID NO: 6322 - RNA, 19 nt, artificial
  Chemically synthesized
cacagucagaaguguuugu

SEQ ID NO: 6323 - RNA, 19 nt, artificial
  Chemically synthesized
ugcuguuucuuuagccacu

SEQ ID NO: 6324 - RNA, 19 nt, artificial
  Chemically synthesized
gagagugugauuauauuuc

SEQ ID NO: 6325 - RNA, 19 nt, artificial
  Chemically synthesized
ucaguauuccuaucacuca

SEQ ID NO: 6326 - RNA, 19 nt, artificial
  Chemically synthesized
cagaaguguuuguuacuga

SEQ ID NO: 6327 - RNA, 19 nt, artificial
  Chemically synthesized
uggcuguuugagaugaguu

SEQ ID NO: 6328 - RNA, 19 nt, artificial
  Chemically synthesized
gaaagucauuucaacucuu

SEQ ID NO: 6329 - RNA, 19 nt, artificial
  Chemically synthesized
ccuccucagaaacagaaca

SEQ ID NO: 6330 - RNA, 19 nt, artificial
  Chemically synthesized
cauaaaagccgaaagguga

SEQ ID NO: 6331 - RNA, 19 nt, artificial
  Chemically synthesized
cuauugaaaggguaaaaga

SEQ ID NO: 6332 - RNA, 19 nt, artificial
  Chemically synthesized
guauuccuaucacucagaa

SEQ ID NO: 6333 - RNA, 19 nt, artificial
  Chemically synthesized
acucuuaccucaucaaguu

SEQ ID NO: 6334 - RNA, 19 nt, artificial
  Chemically synthesized
aaguaaugacugucaugaa

SEQ ID NO: 6335 - RNA, 19 nt, artificial
  Chemically synthesized
cuuauaauuucggauggca

SEQ ID NO: 6336 - RNA, 19 nt, artificial
  Chemically synthesized
ugaguaauuccauggugca

SEQ ID NO: 6337 - RNA, 19 nt, artificial
  Chemically synthesized
ccuuuguuaucuacucaag

SEQ ID NO: 6338 - RNA, 19 nt, artificial
  Chemically synthesized
aacuacgugugaagguauu

SEQ ID NO: 6339 - RNA, 19 nt, artificial
  Chemically synthesized
gggagaaaugaggaaauag

SEQ ID NO: 6340 - RNA, 19 nt, artificial
  Chemically synthesized
gccuaagccaccucucuac

SEQ ID NO: 6341 - RNA, 19 nt, artificial
  Chemically synthesized
ugaggacuggguaaggaau

SEQ ID NO: 6342 - RNA, 19 nt, artificial
  Chemically synthesized
agguugcuguucucaaagu

SEQ ID NO: 6343 - RNA, 19 nt, artificial
  Chemically synthesized
cugcuaaucucaaggagcu

SEQ ID NO: 6344 - RNA, 19 nt, artificial
  Chemically synthesized
cccaugacaaagaaaguca

SEQ ID NO: 6345 - RNA, 19 nt, artificial
  Chemically synthesized
uucuaaucugaccaaucua

SEQ ID NO: 6346 - RNA, 19 nt, artificial
  Chemically synthesized
cugucacuuugucacucga

SEQ ID NO: 6347 - RNA, 19 nt, artificial
  Chemically synthesized
gcuuucaauggcaucuuca

SEQ ID NO: 6348 - RNA, 19 nt, artificial
  Chemically synthesized
caacacuuguucaguuaau

SEQ ID NO: 6349 - RNA, 19 nt, artificial
  Chemically synthesized
cauucaagaaaaggacaau

SEQ ID NO: 6350 - RNA, 19 nt, artificial
  Chemically synthesized
gguuaaagucuaguggcua

SEQ ID NO: 6351 - RNA, 19 nt, artificial
  Chemically synthesized
cauuuaccuugacauuucu

SEQ ID NO: 6352 - RNA, 19 nt, artificial
  Chemically synthesized
cagaccuggcaguuucuga

SEQ ID NO: 6353 - RNA, 19 nt, artificial
  Chemically synthesized
ggaagaaaauuuccgcuuc

SEQ ID NO: 6354 - RNA, 19 nt, artificial
  Chemically synthesized
cagccuccucagaaacaga

SEQ ID NO: 6355 - RNA, 19 nt, artificial
  Chemically synthesized
cuugaaaauggcuggcaau

SEQ ID NO: 6356 - RNA, 19 nt, artificial
  Chemically synthesized
ggagaaaugaggaaauagg

SEQ ID NO: 6357 - RNA, 19 nt, artificial
  Chemically synthesized
gagcaggucuagggugauu

SEQ ID NO: 6358 - RNA, 19 nt, artificial
  Chemically synthesized
guguguguguccgcaugau

SEQ ID NO: 6359 - RNA, 19 nt, artificial
  Chemically synthesized
ccagaaggaacagugggua

SEQ ID NO: 6360 - RNA, 19 nt, artificial
  Chemically synthesized
gcuggguccaacacuuguu

SEQ ID NO: 6361 - RNA, 19 nt, artificial
  Chemically synthesized
ugugacuauugaaagggua

SEQ ID NO: 6362 - RNA, 19 nt, artificial
  Chemically synthesized
cacuacagagacuuuauuc

SEQ ID NO: 6363 - RNA, 19 nt, artificial
  Chemically synthesized
ucacuacagagacuuuauu

SEQ ID NO: 6364 - RNA, 19 nt, artificial
  Chemically synthesized
ggcucgaggaagagaagac

SEQ ID NO: 6365 - RNA, 19 nt, artificial
  Chemically synthesized
gcagggcugcuaaucucaa

SEQ ID NO: 6366 - RNA, 19 nt, artificial
  Chemically synthesized
auucaaggcagggaguaua

SEQ ID NO: 6367 - RNA, 19 nt, artificial
  Chemically synthesized
cagugcagagggaauaaau

SEQ ID NO: 6368 - RNA, 19 nt, artificial
  Chemically synthesized
caucuggauuuccagcauu

SEQ ID NO: 6369 - RNA, 19 nt, artificial
  Chemically synthesized
uaaagaagguucccagaaa

SEQ ID NO: 6370 - RNA, 19 nt, artificial
  Chemically synthesized
cgcaugaucauaucuguau

SEQ ID NO: 6371 - RNA, 19 nt, artificial
  Chemically synthesized
gugugucgguccucagugu

SEQ ID NO: 6372 - RNA, 19 nt, artificial
  Chemically synthesized
gggaagaaaauuuccgcuu

SEQ ID NO: 6373 - RNA, 19 nt, artificial
  Chemically synthesized
gggcugcuaaucucaagga

SEQ ID NO: 6374 - RNA, 19 nt, artificial
  Chemically synthesized
aggugaaaacaucuaugau

SEQ ID NO: 6375 - RNA, 19 nt, artificial
  Chemically synthesized
augagugaguuuucaguau

SEQ ID NO: 6376 - RNA, 19 nt, artificial
  Chemically synthesized
agccaucauaaaaccauuu

SEQ ID NO: 6377 - RNA, 19 nt, artificial
  Chemically synthesized
agcaguucuggucuauaag

SEQ ID NO: 6378 - RNA, 19 nt, artificial
  Chemically synthesized
uacgugugaagguauucaa

SEQ ID NO: 6379 - RNA, 19 nt, artificial
  Chemically synthesized
gauuaacacaugcucacaa

SEQ ID NO: 6380 - RNA, 19 nt, artificial
  Chemically synthesized
cucacaaucuuauccaauc

SEQ ID NO: 6381 - RNA, 19 nt, artificial
  Chemically synthesized
cucaguagaaauggcuuga

SEQ ID NO: 6382 - RNA, 19 nt, artificial
  Chemically synthesized
cacuuccucucacccuuua

SEQ ID NO: 6383 - RNA, 19 nt, artificial
  Chemically synthesized
gaaagagacauuguucuuu

SEQ ID NO: 6384 - RNA, 19 nt, artificial
  Chemically synthesized
gguagaggugaaaacaucu

SEQ ID NO: 6385 - RNA, 19 nt, artificial
  Chemically synthesized
ucacauaaugacuuccaaa

SEQ ID NO: 6386 - RNA, 19 nt, artificial
  Chemically synthesized
caggucuagggugauugaa

SEQ ID NO: 6387 - RNA, 19 nt, artificial
  Chemically synthesized
ucaugaaagcagcauugaa

SEQ ID NO: 6388 - RNA, 19 nt, artificial
  Chemically synthesized
accugucagaugaauaaga

SEQ ID NO: 6389 - RNA, 19 nt, artificial
  Chemically synthesized
gcaggaagcaacaucuauc

SEQ ID NO: 6390 - RNA, 19 nt, artificial
  Chemically synthesized
ccacuggucugcaggcguu

SEQ ID NO: 6391 - RNA, 19 nt, artificial
  Chemically synthesized
ccuggucuuaucauggaca

SEQ ID NO: 6392 - RNA, 19 nt, artificial
  Chemically synthesized
ugggaagaguggauguuau

SEQ ID NO: 6393 - RNA, 19 nt, artificial
  Chemically synthesized
gaaaguagaugugugcauu

SEQ ID NO: 6394 - RNA, 19 nt, artificial
  Chemically synthesized
gcuuccuggucuuaucaug

SEQ ID NO: 6395 - RNA, 19 nt, artificial
  Chemically synthesized
ggugaguaauuccauggug

SEQ ID NO: 6396 - RNA, 19 nt, artificial
  Chemically synthesized
ugagucuuuugaauggaaa

SEQ ID NO: 6397 - RNA, 19 nt, artificial
  Chemically synthesized
cucauguacuagugaaagu

SEQ ID NO: 6398 - RNA, 19 nt, artificial
  Chemically synthesized
caaucuuauccaaucuuuc

SEQ ID NO: 6399 - RNA, 19 nt, artificial
  Chemically synthesized
cccuacucaaucucucuuu

SEQ ID NO: 6400 - RNA, 19 nt, artificial
  Chemically synthesized
gaugucuauggcuguuuga

SEQ ID NO: 6401 - RNA, 19 nt, artificial
  Chemically synthesized
ccaugucucauguacuagu

SEQ ID NO: 6402 - RNA, 19 nt, artificial
  Chemically synthesized
ccaggagaacuacguguga

SEQ ID NO: 6403 - RNA, 19 nt, artificial
  Chemically synthesized
cuugcuguuucuuuagcca

SEQ ID NO: 6404 - RNA, 19 nt, artificial
  Chemically synthesized
ccuuuagcccagaacugcu

SEQ ID NO: 6405 - RNA, 19 nt, artificial
  Chemically synthesized
cccacauugaaacucaaau

SEQ ID NO: 6406 - RNA, 19 nt, artificial
  Chemically synthesized
gugaguuuucaguauuccu

SEQ ID NO: 6407 - RNA, 19 nt, artificial
  Chemically synthesized
uucagaaguugaucuacca

SEQ ID NO: 6408 - RNA, 19 nt, artificial
  Chemically synthesized
aucuaucugaagaggaaaa

SEQ ID NO: 6409 - RNA, 19 nt, artificial
  Chemically synthesized
cuacuaccucgaugauauu

SEQ ID NO: 6410 - RNA, 19 nt, artificial
  Chemically synthesized
ccaaguagucuagcuuucu

SEQ ID NO: 6411 - RNA, 19 nt, artificial
  Chemically synthesized
aaagacagagaaaacagaa

SEQ ID NO: 6412 - RNA, 19 nt, artificial
  Chemically synthesized
gcaucucuagagaacuucc

SEQ ID NO: 6413 - RNA, 19 nt, artificial
  Chemically synthesized
ccugugcaauuugaccauu

SEQ ID NO: 6414 - RNA, 19 nt, artificial
  Chemically synthesized
gugggcauuucaaccaacu

SEQ ID NO: 6415 - RNA, 19 nt, artificial
  Chemically synthesized
gccauugcugccaacauca

SEQ ID NO: 6416 - RNA, 19 nt, artificial
  Chemically synthesized
aaaucucucaaaaggcuua

SEQ ID NO: 6417 - RNA, 19 nt, artificial
  Chemically synthesized
uguuuaagacgugcuucaa

SEQ ID NO: 6418 - RNA, 19 nt, artificial
  Chemically synthesized
ccugaguauuuuucuaauc

SEQ ID NO: 6419 - RNA, 19 nt, artificial
  Chemically synthesized
ucuaccaagccuugaguuu

SEQ ID NO: 6420 - RNA, 19 nt, artificial
  Chemically synthesized
ugugcaauuugaccauuga

SEQ ID NO: 6421 - RNA, 19 nt, artificial
  Chemically synthesized
agaagguggagaagacccu

SEQ ID NO: 6422 - RNA, 19 nt, artificial
  Chemically synthesized
gccuuuucuggacuaucaa

SEQ ID NO: 6423 - RNA, 19 nt, artificial
  Chemically synthesized
gaaggaaacuuggaaaagu

SEQ ID NO: 6424 - RNA, 19 nt, artificial
  Chemically synthesized
aagcccugcuggaugguaa

SEQ ID NO: 6425 - RNA, 19 nt, artificial
  Chemically synthesized
cuucuaacuuccucuccug

SEQ ID NO: 6426 - RNA, 19 nt, artificial
  Chemically synthesized
accugucccugaacccuau

SEQ ID NO: 6427 - RNA, 19 nt, artificial
  Chemically synthesized
agaacaagugauguuugau

SEQ ID NO: 6428 - RNA, 19 nt, artificial
  Chemically synthesized
aguuucaaagguugcuguu

SEQ ID NO: 6429 - RNA, 19 nt, artificial
  Chemically synthesized
ggcacaucuucuggagacg

SEQ ID NO: 6430 - RNA, 19 nt, artificial
  Chemically synthesized
acugcuuugaauacaccaa

SEQ ID NO: 6431 - RNA, 19 nt, artificial
  Chemically synthesized
ggcuccugaugcaagaugc

SEQ ID NO: 6432 - RNA, 19 nt, artificial
  Chemically synthesized
gucuggcugguuuagaagu

SEQ ID NO: 6433 - RNA, 19 nt, artificial
  Chemically synthesized
aagggagaaaugaggaaau

SEQ ID NO: 6434 - RNA, 19 nt, artificial
  Chemically synthesized
cucuagagggccugugcaa

SEQ ID NO: 6435 - RNA, 19 nt, artificial
  Chemically synthesized
uaccaagccuugaguuucu

SEQ ID NO: 6436 - RNA, 19 nt, artificial
  Chemically synthesized
ucaucuucauuguccugca

SEQ ID NO: 6437 - RNA, 19 nt, artificial
  Chemically synthesized
gguugcuguucucaaagug

SEQ ID NO: 6438 - RNA, 19 nt, artificial
  Chemically synthesized
ugaguugcagcagaaguuu

SEQ ID NO: 6439 - RNA, 19 nt, artificial
  Chemically synthesized
ccgcuuccuggucuuauca

SEQ ID NO: 6440 - RNA, 19 nt, artificial
  Chemically synthesized
cgugcugguaucaucuuca

SEQ ID NO: 6441 - RNA, 19 nt, artificial
  Chemically synthesized
uggucauucucgagcaugu

SEQ ID NO: 6442 - RNA, 19 nt, artificial
  Chemically synthesized
cucaaaacuuugaaagaac

SEQ ID NO: 6443 - RNA, 19 nt, artificial
  Chemically synthesized
augcuaagguugccgcuuu

SEQ ID NO: 6444 - RNA, 19 nt, artificial
  Chemically synthesized
cucacugccaggagaacua

SEQ ID NO: 6445 - RNA, 19 nt, artificial
  Chemically synthesized
gucuccuuacagagguuaa

SEQ ID NO: 6446 - RNA, 19 nt, artificial
  Chemically synthesized
ugccuucacuacagagacu

SEQ ID NO: 6447 - RNA, 19 nt, artificial
  Chemically synthesized
gcuuccagugcagagggaa

SEQ ID NO: 6448 - RNA, 19 nt, artificial
  Chemically synthesized
gaucuaccaagccuugagu

SEQ ID NO: 6449 - RNA, 19 nt, artificial
  Chemically synthesized
guguucacuuuuuccuuuu

SEQ ID NO: 6450 - RNA, 19 nt, artificial
  Chemically synthesized
gucaaggaacccaugacaa

SEQ ID NO: 6451 - RNA, 19 nt, artificial
  Chemically synthesized
ugcucagaccuggcaguuu

SEQ ID NO: 6452 - RNA, 19 nt, artificial
  Chemically synthesized
gcaacaucuaucugaagag

SEQ ID NO: 6453 - RNA, 19 nt, artificial
  Chemically synthesized
gacuaaaauacagagucuu

SEQ ID NO: 6454 - RNA, 19 nt, artificial
  Chemically synthesized
gaucauaucuguauagaag

SEQ ID NO: 6455 - RNA, 19 nt, artificial
  Chemically synthesized
aucacauaaugacuuccaa

SEQ ID NO: 6456 - RNA, 19 nt, artificial
  Chemically synthesized
guugggcaaugcuccuuga

SEQ ID NO: 6457 - RNA, 19 nt, artificial
  Chemically synthesized
gguccaacacuuguucagu

SEQ ID NO: 6458 - RNA, 19 nt, artificial
  Chemically synthesized
guuuagcccugggagccuu

SEQ ID NO: 6459 - RNA, 19 nt, artificial
  Chemically synthesized
ugggagaauuuagaaauga

SEQ ID NO: 6460 - RNA, 19 nt, artificial
  Chemically synthesized
ggaagaguggauguuauca

SEQ ID NO: 6461 - RNA, 19 nt, artificial
  Chemically synthesized
ccucaucaaguugaauaaa

SEQ ID NO: 6462 - RNA, 19 nt, artificial
  Chemically synthesized
cugggagaauuuagaaaug

SEQ ID NO: 6463 - RNA, 19 nt, artificial
  Chemically synthesized
aaggaaguauggaaaagua

SEQ ID NO: 6464 - RNA, 19 nt, artificial
  Chemically synthesized
ggaccuuuccagcaacaag

SEQ ID NO: 6465 - RNA, 19 nt, artificial
  Chemically synthesized
gccuaaaguauuuagaucu

SEQ ID NO: 6466 - RNA, 19 nt, artificial
  Chemically synthesized
uuacagucucaaucacaua

SEQ ID NO: 6467 - RNA, 19 nt, artificial
  Chemically synthesized
aacagaaagagacauuguu

SEQ ID NO: 6468 - RNA, 19 nt, artificial
  Chemically synthesized
uggucuuaucauggacaau

SEQ ID NO: 6469 - RNA, 19 nt, artificial
  Chemically synthesized
gacaaagaaagucauuuca

SEQ ID NO: 6470 - RNA, 19 nt, artificial
  Chemically synthesized
ucagaaacagaacauucaa

SEQ ID NO: 6471 - RNA, 19 nt, artificial
  Chemically synthesized
cuggaaauaugaccacagu

SEQ ID NO: 6472 - RNA, 19 nt, artificial
  Chemically synthesized
agaaggaacaguggguaca

SEQ ID NO: 6473 - RNA, 19 nt, artificial
  Chemically synthesized
cauuguucuuuuccugagu

SEQ ID NO: 6474 - RNA, 19 nt, artificial
  Chemically synthesized
aguugucaaaacuggaaau

SEQ ID NO: 6475 - RNA, 19 nt, artificial
  Chemically synthesized
ccugcgugagaccagaaag

SEQ ID NO: 6476 - RNA, 19 nt, artificial
  Chemically synthesized
ugacaaaucugcucuagag

SEQ ID NO: 6477 - RNA, 19 nt, artificial
  Chemically synthesized
cuuuuaaacgggaagaaaa

SEQ ID NO: 6478 - RNA, 19 nt, artificial
  Chemically synthesized
agagaaaacagaaagagac

SEQ ID NO: 6479 - RNA, 19 nt, artificial
  Chemically synthesized
caguugucuccaacagcau

SEQ ID NO: 6480 - RNA, 19 nt, artificial
  Chemically synthesized
gugugacuauugaaagggu

SEQ ID NO: 6481 - RNA, 19 nt, artificial
  Chemically synthesized
ccuucucacugccaggaga

SEQ ID NO: 6482 - RNA, 19 nt, artificial
  Chemically synthesized
gggcaugccugugcugagu

SEQ ID NO: 6483 - RNA, 19 nt, artificial
  Chemically synthesized
gauaugcagggcugcuaau

SEQ ID NO: 6484 - RNA, 19 nt, artificial
  Chemically synthesized
aguugucuccaacagcauu

SEQ ID NO: 6485 - RNA, 19 nt, artificial
  Chemically synthesized
ugcacauaucccuauguau

SEQ ID NO: 6486 - RNA, 19 nt, artificial
  Chemically synthesized
ccucuccugugacaaaaga

SEQ ID NO: 6487 - RNA, 19 nt, artificial
  Chemically synthesized
uggauuuccagcauuccaa

SEQ ID NO: 6488 - RNA, 19 nt, artificial
  Chemically synthesized
guauucaaggcagggagua

SEQ ID NO: 6489 - RNA, 19 nt, artificial
  Chemically synthesized
caauuaugucugaaugaag

SEQ ID NO: 6490 - RNA, 19 nt, artificial
  Chemically synthesized
cucacccuuuagcccagaa

SEQ ID NO: 6491 - RNA, 19 nt, artificial
  Chemically synthesized
uuugguucugggagaauuu

SEQ ID NO: 6492 - RNA, 19 nt, artificial
  Chemically synthesized
ggccugugcaauuugacca

SEQ ID NO: 6493 - RNA, 19 nt, artificial
  Chemically synthesized
ggagccuuuucuggacuau

SEQ ID NO: 6494 - RNA, 19 nt, artificial
  Chemically synthesized
guugcagcagaaguuuauu

SEQ ID NO: 6495 - RNA, 19 nt, artificial
  Chemically synthesized
auccaugaagguuuccaua

SEQ ID NO: 6496 - RNA, 19 nt, artificial
  Chemically synthesized
uggcaauucuuuccaggaa

SEQ ID NO: 6497 - RNA, 19 nt, artificial
  Chemically synthesized
cugucuccuuacagagguu

SEQ ID NO: 6498 - RNA, 19 nt, artificial
  Chemically synthesized
gcucacaaucuuauccaau

SEQ ID NO: 6499 - RNA, 19 nt, artificial
  Chemically synthesized
ggcaguuucugagcagucg

SEQ ID NO: 6500 - RNA, 19 nt, artificial
  Chemically synthesized
gaaguugaacgaauggaau

SEQ ID NO: 6501 - RNA, 19 nt, artificial
  Chemically synthesized
aggucuagggugauugaac

SEQ ID NO: 6502 - RNA, 19 nt, artificial
  Chemically synthesized
caaaaggcuuacuuucacu

SEQ ID NO: 6503 - RNA, 19 nt, artificial
  Chemically synthesized
aaaacuuccuuccagauau

SEQ ID NO: 6504 - RNA, 19 nt, artificial
  Chemically synthesized
ccgcuuucacuuccucuca

SEQ ID NO: 6505 - RNA, 19 nt, artificial
  Chemically synthesized
gugugcuuguaguaucugu

SEQ ID NO: 6506 - RNA, 19 nt, artificial
  Chemically synthesized
aggaggaagggagaaauga

SEQ ID NO: 6507 - RNA, 19 nt, artificial
  Chemically synthesized
caacaaaggugggaaugcu

SEQ ID NO: 6508 - RNA, 19 nt, artificial
  Chemically synthesized
caucauccaugaagguuuc

SEQ ID NO: 6509 - RNA, 19 nt, artificial
  Chemically synthesized
cuuugaauaugagauugcu

SEQ ID NO: 6510 - RNA, 19 nt, artificial
  Chemically synthesized
auggaauccagaaggaaca

SEQ ID NO: 6511 - RNA, 19 nt, artificial
  Chemically synthesized
aacuagaacaucuggauuu

SEQ ID NO: 6512 - RNA, 19 nt, artificial
  Chemically synthesized
aaggcagggaguauacauu

SEQ ID NO: 6513 - RNA, 19 nt, artificial
  Chemically synthesized
caaaggugggaaugcuuuu

SEQ ID NO: 6514 - RNA, 19 nt, artificial
  Chemically synthesized
agugucaacuggagcaguu

SEQ ID NO: 6515 - RNA, 19 nt, artificial
  Chemically synthesized
aggaagagaagacaccagu

SEQ ID NO: 6516 - RNA, 19 nt, artificial
  Chemically synthesized
gaauaagaccaucauuggu

SEQ ID NO: 6517 - RNA, 19 nt, artificial
  Chemically synthesized
ccaaucuagagcacuugga

SEQ ID NO: 6518 - RNA, 19 nt, artificial
  Chemically synthesized
agaaaacagaaagagacau

SEQ ID NO: 6519 - RNA, 19 nt, artificial
  Chemically synthesized
cuucuggagacgacucaga

SEQ ID NO: 6520 - RNA, 19 nt, artificial
  Chemically synthesized
aguggguacaggaugcaau

SEQ ID NO: 6521 - RNA, 19 nt, artificial
  Chemically synthesized
agaagguucccagaaaaga

SEQ ID NO: 6522 - RNA, 19 nt, artificial
  Chemically synthesized
auaagguuguuuaagacgu

SEQ ID NO: 6523 - RNA, 19 nt, artificial
  Chemically synthesized
auaucaccugucagaugaa

SEQ ID NO: 6524 - RNA, 19 nt, artificial
  Chemically synthesized
ccacuauuuuucaaggaag

SEQ ID NO: 6525 - RNA, 19 nt, artificial
  Chemically synthesized
caauuggcaggaagcaaca

SEQ ID NO: 6526 - RNA, 19 nt, artificial
  Chemically synthesized
gcacaucuucuggagacga

SEQ ID NO: 6527 - RNA, 19 nt, artificial
  Chemically synthesized
ucugggagaauuuagaaau

SEQ ID NO: 6528 - RNA, 19 nt, artificial
  Chemically synthesized
uccucagugugcuuguagu

SEQ ID NO: 6529 - RNA, 19 nt, artificial
  Chemically synthesized
aggaacccaugacaaagaa

SEQ ID NO: 6530 - RNA, 19 nt, artificial
  Chemically synthesized
cuaaauaugagccacaaca

SEQ ID NO: 6531 - RNA, 19 nt, artificial
  Chemically synthesized
ccuuccuggaccucucuca

SEQ ID NO: 6532 - RNA, 19 nt, artificial
  Chemically synthesized
gaacuuaauguggcucaca

SEQ ID NO: 6533 - RNA, 19 nt, artificial
  Chemically synthesized
aaauggcuugaguuucaaa

SEQ ID NO: 6534 - RNA, 19 nt, artificial
  Chemically synthesized
agagaagacaccagugccu

SEQ ID NO: 6535 - RNA, 19 nt, artificial
  Chemically synthesized
uggagacaaaucuagcauc

SEQ ID NO: 6536 - RNA, 19 nt, artificial
  Chemically synthesized
cauacuuagacuacuaccu

SEQ ID NO: 6537 - RNA, 19 nt, artificial
  Chemically synthesized
auuccgauuagcauacuua

SEQ ID NO: 6538 - RNA, 19 nt, artificial
  Chemically synthesized
acagucucaaucacauaau

SEQ ID NO: 6539 - RNA, 19 nt, artificial
  Chemically synthesized
ugcaauggaucaaggacca

SEQ ID NO: 6540 - RNA, 19 nt, artificial
  Chemically synthesized
cuacgugugaagguauuca

SEQ ID NO: 6541 - RNA, 19 nt, artificial
  Chemically synthesized
agccuccucagaaacagaa

SEQ ID NO: 6542 - RNA, 19 nt, artificial
  Chemically synthesized
agugauguuugauggaccu

SEQ ID NO: 6543 - RNA, 19 nt, artificial
  Chemically synthesized
guagaggugaaaacaucua

SEQ ID NO: 6544 - RNA, 19 nt, artificial
  Chemically synthesized
gagaacuacgugugaaggu

SEQ ID NO: 6545 - RNA, 19 nt, artificial
  Chemically synthesized
gggcuagaggcaggaagga

SEQ ID NO: 6546 - RNA, 19 nt, artificial
  Chemically synthesized
gguuuagaaguccaucguu

SEQ ID NO: 6547 - RNA, 19 nt, artificial
  Chemically synthesized
auuggauacguuuccuuau

SEQ ID NO: 6548 - RNA, 19 nt, artificial
  Chemically synthesized
uggcuugaguuucaaaggu

SEQ ID NO: 6549 - RNA, 19 nt, artificial
  Chemically synthesized
gaaagaacuuaauguggcu

SEQ ID NO: 6550 - RNA, 19 nt, artificial
  Chemically synthesized
aaggaaacuuggaaaaguu

SEQ ID NO: 6551 - RNA, 19 nt, artificial
  Chemically synthesized
accaggugcauuuaaagaa

SEQ ID NO: 6552 - RNA, 19 nt, artificial
  Chemically synthesized
ugucagaugaauaagacca

SEQ ID NO: 6553 - RNA, 19 nt, artificial
  Chemically synthesized
gaaugcuuuuucagaaguu

SEQ ID NO: 6554 - RNA, 19 nt, artificial
  Chemically synthesized
ugcuaagggugaguaauuc

SEQ ID NO: 6555 - RNA, 19 nt, artificial
  Chemically synthesized
caugaaaugaguugcagca

SEQ ID NO: 6556 - RNA, 19 nt, artificial
  Chemically synthesized
gugcugguaucaucuucau

SEQ ID NO: 6557 - RNA, 19 nt, artificial
  Chemically synthesized
uguuuguuacugaguguuu

SEQ ID NO: 6558 - RNA, 19 nt, artificial
  Chemically synthesized
uggcuguggagacaaaucu

SEQ ID NO: 6559 - RNA, 19 nt, artificial
  Chemically synthesized
ucgagcauguucuauuuuu

SEQ ID NO: 6560 - RNA, 19 nt, artificial
  Chemically synthesized
gcgugagaccagaaagcug

SEQ ID NO: 6561 - RNA, 19 nt, artificial
  Chemically synthesized
ccagaaagcugggagcccu

SEQ ID NO: 6562 - RNA, 19 nt, artificial
  Chemically synthesized
cuguucucaaagugauuuu

SEQ ID NO: 6563 - RNA, 19 nt, artificial
  Chemically synthesized
cucuaccuuaauauugaca

SEQ ID NO: 6564 - RNA, 19 nt, artificial
  Chemically synthesized
ccucucuaccuuaauauug

SEQ ID NO: 6565 - RNA, 19 nt, artificial
  Chemically synthesized
cuaccaagccuugaguuuc

SEQ ID NO: 6566 - RNA, 19 nt, artificial
  Chemically synthesized
aggagaacuacgugugaag

SEQ ID NO: 6567 - RNA, 19 nt, artificial
  Chemically synthesized
gucagaaguguuuguuacu

SEQ ID NO: 6568 - RNA, 19 nt, artificial
  Chemically synthesized
ccauccagaguuuagcccu

SEQ ID NO: 6569 - RNA, 19 nt, artificial
  Chemically synthesized
auuucggauggcaacauuu

SEQ ID NO: 6570 - RNA, 19 nt, artificial
  Chemically synthesized
ugagaugaguucucuacuc

SEQ ID NO: 6571 - RNA, 19 nt, artificial
  Chemically synthesized
aguauuuagaucugagcuu

SEQ ID NO: 6572 - RNA, 19 nt, artificial
  Chemically synthesized
caaugcuccuugaccacau

SEQ ID NO: 6573 - RNA, 19 nt, artificial
  Chemically synthesized
uggcaggaagcaacaucua

SEQ ID NO: 6574 - RNA, 19 nt, artificial
  Chemically synthesized
auccagagccgcuggugua

SEQ ID NO: 6575 - RNA, 19 nt, artificial
  Chemically synthesized
acagaagcagugaggauga

SEQ ID NO: 6576 - RNA, 19 nt, artificial
  Chemically synthesized
cuugggcuuagaacaacua

SEQ ID NO: 6577 - RNA, 19 nt, artificial
  Chemically synthesized
uacuaaauaugagccacaa

SEQ ID NO: 6578 - RNA, 19 nt, artificial
  Chemically synthesized
accaugaguucaaacuucu

SEQ ID NO: 6579 - RNA, 19 nt, artificial
  Chemically synthesized
acuugugaacaccagaguu

SEQ ID NO: 6580 - RNA, 19 nt, artificial
  Chemically synthesized
caaaucucucaaaaggcuu

SEQ ID NO: 6581 - RNA, 19 nt, artificial
  Chemically synthesized
ugaaaugaguugcagcaga

SEQ ID NO: 6582 - RNA, 19 nt, artificial
  Chemically synthesized
ccugagucuuuugaaugga

SEQ ID NO: 6583 - RNA, 19 nt, artificial
  Chemically synthesized
acgucuugccuauaagcua

SEQ ID NO: 6584 - RNA, 19 nt, artificial
  Chemically synthesized
ggcagggaguauacauugc

SEQ ID NO: 6585 - RNA, 19 nt, artificial
  Chemically synthesized
gaaacuugaccuuccugga

SEQ ID NO: 6586 - RNA, 19 nt, artificial
  Chemically synthesized
augaggacuggguaaggaa

SEQ ID NO: 6587 - RNA, 19 nt, artificial
  Chemically synthesized
ccagugcagagggaauaaa

SEQ ID NO: 6588 - RNA, 19 nt, artificial
  Chemically synthesized
auuccauggugcacuagau

SEQ ID NO: 6589 - RNA, 19 nt, artificial
  Chemically synthesized
cucaaucacauaaugacuu

SEQ ID NO: 6590 - RNA, 19 nt, artificial
  Chemically synthesized
cccuaucagggcugugugu

SEQ ID NO: 6591 - RNA, 19 nt, artificial
  Chemically synthesized
agaaguugaucuaccaagc

SEQ ID NO: 6592 - RNA, 19 nt, artificial
  Chemically synthesized
accacuauuuuucaaggaa

SEQ ID NO: 6593 - RNA, 19 nt, artificial
  Chemically synthesized
gugcacauaucccuaugua

SEQ ID NO: 6594 - RNA, 19 nt, artificial
  Chemically synthesized
cgccuucucagcaggaaca

SEQ ID NO: 6595 - RNA, 19 nt, artificial
  Chemically synthesized
guccugcagaagguggaga

SEQ ID NO: 6596 - RNA, 19 nt, artificial
  Chemically synthesized
caaagugauuuugggacaa

SEQ ID NO: 6597 - RNA, 19 nt, artificial
  Chemically synthesized
uccuaaggaaaccugauua

SEQ ID NO: 6598 - RNA, 19 nt, artificial
  Chemically synthesized
gguaaaucauggaauccag

SEQ ID NO: 6599 - RNA, 19 nt, artificial
  Chemically synthesized
uaguaucuguuguagcagu

SEQ ID NO: 6600 - RNA, 19 nt, artificial
  Chemically synthesized
guguuuccaugucucaugu

SEQ ID NO: 6601 - RNA, 19 nt, artificial
  Chemically synthesized
aaacaaugugucuggaauu

SEQ ID NO: 6602 - RNA, 19 nt, artificial
  Chemically synthesized
aucuucacagagcugagaa

SEQ ID NO: 6603 - RNA, 19 nt, artificial
  Chemically synthesized
ugacuauugaaaggguaaa

SEQ ID NO: 6604 - RNA, 19 nt, artificial
  Chemically synthesized
aaucuagcaucucuagaga

SEQ ID NO: 6605 - RNA, 19 nt, artificial
  Chemically synthesized
gaaaaggaggaagggagaa

SEQ ID NO: 6606 - RNA, 19 nt, artificial
  Chemically synthesized
acaaaaguccagaaugcua

SEQ ID NO: 6607 - RNA, 19 nt, artificial
  Chemically synthesized
agacagagaaaacagaaag

SEQ ID NO: 6608 - RNA, 19 nt, artificial
  Chemically synthesized
gaacaucccuggguguguu

SEQ ID NO: 6609 - RNA, 19 nt, artificial
  Chemically synthesized
cucacaaccauccugguca

SEQ ID NO: 6610 - RNA, 19 nt, artificial
  Chemically synthesized
cuuuagcccagaacugcuu

SEQ ID NO: 6611 - RNA, 19 nt, artificial
  Chemically synthesized
ggaaugcuuuuucagaagu

SEQ ID NO: 6612 - RNA, 19 nt, artificial
  Chemically synthesized
gauggaccucugaaucucu

SEQ ID NO: 6613 - RNA, 19 nt, artificial
  Chemically synthesized
agccuugaguuucuagauc

SEQ ID NO: 6614 - RNA, 19 nt, artificial
  Chemically synthesized
gaacuacagcauuuuccaa

SEQ ID NO: 6615 - RNA, 19 nt, artificial
  Chemically synthesized
uuucggauggcaacauuua

SEQ ID NO: 6616 - RNA, 19 nt, artificial
  Chemically synthesized
caguggguacaggaugcaa

SEQ ID NO: 6617 - RNA, 19 nt, artificial
  Chemically synthesized
ccuccagguucuugauuac

SEQ ID NO: 6618 - RNA, 19 nt, artificial
  Chemically synthesized
acaaugugucuggaauuaa

SEQ ID NO: 6619 - RNA, 19 nt, artificial
  Chemically synthesized
gguggagcuguaccgccuu

SEQ ID NO: 6620 - RNA, 19 nt, artificial
  Chemically synthesized
gagaauuuagaaaugaagg

SEQ ID NO: 6621 - RNA, 19 nt, artificial
  Chemically synthesized
gguucuacaucaaaugccc

SEQ ID NO: 6622 - RNA, 19 nt, artificial
  Chemically synthesized
gggaaugcuuuuucagaag

SEQ ID NO: 6623 - RNA, 19 nt, artificial
  Chemically synthesized
cagccuaaaguauuuagau

SEQ ID NO: 6624 - RNA, 19 nt, artificial
  Chemically synthesized
ggcaugccugugcugaguu

SEQ ID NO: 6625 - RNA, 19 nt, artificial
  Chemically synthesized
gugugcauuugugcacaua

SEQ ID NO: 6626 - RNA, 19 nt, artificial
  Chemically synthesized
gaaaggugauuguuguggu

SEQ ID NO: 6627 - RNA, 19 nt, artificial
  Chemically synthesized
uuauaauuucggauggcaa

SEQ ID NO: 6628 - RNA, 19 nt, artificial
  Chemically synthesized
gcucggucagacggugaua

SEQ ID NO: 6629 - RNA, 19 nt, artificial
  Chemically synthesized
agaaauuaggcuucauaag

SEQ ID NO: 6630 - RNA, 19 nt, artificial
  Chemically synthesized
ucuacuugaugacugcagu

SEQ ID NO: 6631 - RNA, 19 nt, artificial
  Chemically synthesized
ucuacucaagccaggauga

SEQ ID NO: 6632 - RNA, 19 nt, artificial
  Chemically synthesized
cucagaaugacuuugcuug

SEQ ID NO: 6633 - RNA, 19 nt, artificial
  Chemically synthesized
cuuccaaaaaacaggaacu

SEQ ID NO: 6634 - RNA, 19 nt, artificial
  Chemically synthesized
ccaacucagucaaggaacc

SEQ ID NO: 6635 - RNA, 19 nt, artificial
  Chemically synthesized
uguuugagaugaguucucu

SEQ ID NO: 6636 - RNA, 19 nt, artificial
  Chemically synthesized
gccacaugucaggccuuau

SEQ ID NO: 6637 - RNA, 19 nt, artificial
  Chemically synthesized
cugcauaaaguaugguaga

SEQ ID NO: 6638 - RNA, 19 nt, artificial
  Chemically synthesized
accucauuuaccuugacau

SEQ ID NO: 6639 - RNA, 19 nt, artificial
  Chemically synthesized
uacucaaucucucuuuaga

SEQ ID NO: 6640 - RNA, 19 nt, artificial
  Chemically synthesized
ggucagacggugauagcga

SEQ ID NO: 6641 - RNA, 19 nt, artificial
  Chemically synthesized
agucuagcuuucuuaaauc

SEQ ID NO: 6642 - RNA, 19 nt, artificial
  Chemically synthesized
acacuuaccuggaguggga

SEQ ID NO: 6643 - RNA, 19 nt, artificial
  Chemically synthesized
agaacugcuuugaauacac

SEQ ID NO: 6644 - RNA, 19 nt, artificial
  Chemically synthesized
aguauuaaaugcugccaca

SEQ ID NO: 6645 - RNA, 19 nt, artificial
  Chemically synthesized
ccaggaugaggacugggua

SEQ ID NO: 6646 - RNA, 19 nt, artificial
  Chemically synthesized
ggucugcaggcguuuucuu

SEQ ID NO: 6647 - RNA, 19 nt, artificial
  Chemically synthesized
ccucgaugauauuauugac

SEQ ID NO: 6648 - RNA, 19 nt, artificial
  Chemically synthesized
agcaacaagauucaaagua

SEQ ID NO: 6649 - RNA, 19 nt, artificial
  Chemically synthesized
uggcugguuuagaagucca

SEQ ID NO: 6650 - RNA, 19 nt, artificial
  Chemically synthesized
cagauaucuucacagagcu

SEQ ID NO: 6651 - RNA, 19 nt, artificial
  Chemically synthesized
gacuuugcuuguacuugug

SEQ ID NO: 6652 - RNA, 19 nt, artificial
  Chemically synthesized
aucaccugucagaugaaua

SEQ ID NO: 6653 - RNA, 19 nt, artificial
  Chemically synthesized
ggcuuguccagucucgaag

SEQ ID NO: 6654 - RNA, 19 nt, artificial
  Chemically synthesized
ggaggucaccuuuucuuga

SEQ ID NO: 6655 - RNA, 19 nt, artificial
  Chemically synthesized
ugaccacagucagaagugu

SEQ ID NO: 6656 - RNA, 19 nt, artificial
  Chemically synthesized
uccugcgugagaccagaaa

SEQ ID NO: 6657 - RNA, 19 nt, artificial
  Chemically synthesized
ugccuuuguuaucuacuca

SEQ ID NO: 6658 - RNA, 19 nt, artificial
  Chemically synthesized
uguuugauggaccucugaa

SEQ ID NO: 6659 - RNA, 19 nt, artificial
  Chemically synthesized
gcggcacaucuucuggaga

SEQ ID NO: 6660 - RNA, 19 nt, artificial
  Chemically synthesized
cacagagcugagaaacuug

SEQ ID NO: 6661 - RNA, 19 nt, artificial
  Chemically synthesized
ggagaacuacgugugaagg

SEQ ID NO: 6662 - RNA, 19 nt, artificial
  Chemically synthesized
cguuuucuucuucuaacuu

SEQ ID NO: 6663 - RNA, 19 nt, artificial
  Chemically synthesized
gggugauugaacaucccug

SEQ ID NO: 6664 - RNA, 19 nt, artificial
  Chemically synthesized
uguucauccagccuccuca

SEQ ID NO: 6665 - RNA, 19 nt, artificial
  Chemically synthesized
agccgaaaggugauuguug

SEQ ID NO: 6666 - RNA, 19 nt, artificial
  Chemically synthesized
caccagugccucagaaacu

SEQ ID NO: 6667 - RNA, 19 nt, artificial
  Chemically synthesized
aaacuuguauucaaggucu

SEQ ID NO: 6668 - RNA, 19 nt, artificial
  Chemically synthesized
uguacuugugaacaccaga

SEQ ID NO: 6669 - RNA, 19 nt, artificial
  Chemically synthesized
ugccugugcugaguuugaa

SEQ ID NO: 6670 - RNA, 19 nt, artificial
  Chemically synthesized
gagacaaaucuagcaucuc

SEQ ID NO: 6671 - RNA, 19 nt, artificial
  Chemically synthesized
agggaguauacauugcugu

SEQ ID NO: 6672 - RNA, 19 nt, artificial
  Chemically synthesized
ccuggaccucucucagugu

SEQ ID NO: 6673 - RNA, 19 nt, artificial
  Chemically synthesized
gccuuccucuccugcguga

SEQ ID NO: 6674 - RNA, 19 nt, artificial
  Chemically synthesized
ggaugcaauuggcaggaag

SEQ ID NO: 6675 - RNA, 19 nt, artificial
  Chemically synthesized
aguucaaacuucuugggcu

SEQ ID NO: 6676 - RNA, 19 nt, artificial
  Chemically synthesized
uccgauuagcauacuuaga

SEQ ID NO: 6677 - RNA, 19 nt, artificial
  Chemically synthesized
uucagaguguguuugguuu

SEQ ID NO: 6678 - RNA, 19 nt, artificial
  Chemically synthesized
aagggugaguaauuccaug

SEQ ID NO: 6679 - RNA, 19 nt, artificial
  Chemically synthesized
ccuggucauucucgagcau

SEQ ID NO: 6680 - RNA, 19 nt, artificial
  Chemically synthesized
aguucuggucuauaaguuc

SEQ ID NO: 6681 - RNA, 19 nt, artificial
  Chemically synthesized
acuguaaauuuggacaguu

SEQ ID NO: 6682 - RNA, 19 nt, artificial
  Chemically synthesized
agucuaguggcuaauuccu

SEQ ID NO: 6683 - RNA, 19 nt, artificial
  Chemically synthesized
caaagaaagucauuucaac

SEQ ID NO: 6684 - RNA, 19 nt, artificial
  Chemically synthesized
aauguggcucacaaucuua

SEQ ID NO: 6685 - RNA, 19 nt, artificial
  Chemically synthesized
uaagggugaguaauuccau

SEQ ID NO: 6686 - RNA, 19 nt, artificial
  Chemically synthesized
cauggaauccagaaggaac

SEQ ID NO: 6687 - RNA, 19 nt, artificial
  Chemically synthesized
cccuuaucccuuaugcuug

SEQ ID NO: 6688 - RNA, 19 nt, artificial
  Chemically synthesized
aggugggaaugcuuuuuca

SEQ ID NO: 6689 - RNA, 19 nt, artificial
  Chemically synthesized
gcauuccaauuugaaacaa

SEQ ID NO: 6690 - RNA, 19 nt, artificial
  Chemically synthesized
cuagagcacuuggaccuuu

SEQ ID NO: 6691 - RNA, 19 nt, artificial
  Chemically synthesized
aacaaugugucuggaauua

SEQ ID NO: 6692 - RNA, 19 nt, artificial
  Chemically synthesized
aucucaaggagcuuccagu

SEQ ID NO: 6693 - RNA, 19 nt, artificial
  Chemically synthesized
uugauuacagucucaauca

SEQ ID NO: 6694 - RNA, 19 nt, artificial
  Chemically synthesized
ggaacacuuaccuggagug

SEQ ID NO: 6695 - RNA, 19 nt, artificial
  Chemically synthesized
uuugguuugagcaggucua

SEQ ID NO: 6696 - RNA, 19 nt, artificial
  Chemically synthesized
gacugucaugaaagcagca

SEQ ID NO: 6697 - RNA, 19 nt, artificial
  Chemically synthesized
aaacaucuaugaugccuuu

SEQ ID NO: 6698 - RNA, 19 nt, artificial
  Chemically synthesized
gaugucauuccaaaguuau

SEQ ID NO: 6699 - RNA, 19 nt, artificial
  Chemically synthesized
gcugguaucaucuucauug

SEQ ID NO: 6700 - RNA, 19 nt, artificial
  Chemically synthesized
uccagugcagagggaauaa

SEQ ID NO: 6701 - RNA, 19 nt, artificial
  Chemically synthesized
guguuuguuacugaguguu

SEQ ID NO: 6702 - RNA, 19 nt, artificial
  Chemically synthesized
augaaagcagcauugaaau

SEQ ID NO: 6703 - RNA, 19 nt, artificial
  Chemically synthesized
uccgcaugaucauaucugu

SEQ ID NO: 6704 - RNA, 19 nt, artificial
  Chemically synthesized
gagugugacuauugaaagg

SEQ ID NO: 6705 - RNA, 19 nt, artificial
  Chemically synthesized
cuucucacugccaggagaa

SEQ ID NO: 6706 - RNA, 19 nt, artificial
  Chemically synthesized
gaguuuccugcaauggauc

SEQ ID NO: 6707 - RNA, 19 nt, artificial
  Chemically synthesized
gucacucgaugucauucca

SEQ ID NO: 6708 - RNA, 19 nt, artificial
  Chemically synthesized
guguguuuccaugucucau

SEQ ID NO: 6709 - RNA, 19 nt, artificial
  Chemically synthesized
aagaguggauguuaucauu

SEQ ID NO: 6710 - RNA, 19 nt, artificial
  Chemically synthesized
uaauguggcucacaaucuu

SEQ ID NO: 6711 - RNA, 19 nt, artificial
  Chemically synthesized
ggaauccagaaggaacagu

SEQ ID NO: 6712 - RNA, 19 nt, artificial
  Chemically synthesized
gcuaagggugaguaauucc

SEQ ID NO: 6713 - RNA, 19 nt, artificial
  Chemically synthesized
caaucucucuuuagaccug

SEQ ID NO: 6714 - RNA, 19 nt, artificial
  Chemically synthesized
gaccaaucuagagcacuug

SEQ ID NO: 6715 - RNA, 19 nt, artificial
  Chemically synthesized
gcaggaacacuuaccugga

SEQ ID NO: 6716 - RNA, 19 nt, artificial
  Chemically synthesized
ggucuggcugguuuagaag

SEQ ID NO: 6717 - RNA, 19 nt, artificial
  Chemically synthesized
uuccaugucucauguacua

SEQ ID NO: 6718 - RNA, 19 nt, artificial
  Chemically synthesized
cacaaucuuauccaaucuu

SEQ ID NO: 6719 - RNA, 19 nt, artificial
  Chemically synthesized
gacaucucaaaacuuugaa

SEQ ID NO: 6720 - RNA, 19 nt, artificial
  Chemically synthesized
acuuggaccuuuccagcaa

SEQ ID NO: 6721 - RNA, 19 nt, artificial
  Chemically synthesized
cguuugguucugggagaau

SEQ ID NO: 6722 - RNA, 19 nt, artificial
  Chemically synthesized
aguauuccuaucacucaga

SEQ ID NO: 6723 - RNA, 19 nt, artificial
  Chemically synthesized
aguagaugugugcauuugu

SEQ ID NO: 6724 - RNA, 19 nt, artificial
  Chemically synthesized
guggauguuaucauugaga

SEQ ID NO: 6725 - RNA, 19 nt, artificial
  Chemically synthesized
gguucccagaaaagaaugu

SEQ ID NO: 6726 - RNA, 19 nt, artificial
  Chemically synthesized
ucuguauagaagagagugu

SEQ ID NO: 6727 - RNA, 19 nt, artificial
  Chemically synthesized
auaagaccaucauuggugu

SEQ ID NO: 6728 - RNA, 19 nt, artificial
  Chemically synthesized
ucuugaaaauggcuggcaa

SEQ ID NO: 6729 - RNA, 19 nt, artificial
  Chemically synthesized
aguuuccugcaauggauca

SEQ ID NO: 6730 - RNA, 19 nt, artificial
  Chemically synthesized
acagagcugagaaacuuga

SEQ ID NO: 6731 - RNA, 19 nt, artificial
  Chemically synthesized
cugaguuugaauaucaccu

SEQ ID NO: 6732 - RNA, 19 nt, artificial
  Chemically synthesized
acauucaagaaaaggacaa

SEQ ID NO: 6733 - RNA, 19 nt, artificial
  Chemically synthesized
accuuuucuugauuccaga

SEQ ID NO: 6734 - RNA, 19 nt, artificial
  Chemically synthesized
ccagaacugcuuugaauac

SEQ ID NO: 6735 - RNA, 19 nt, artificial
  Chemically synthesized
agugauuuugggacaacca

SEQ ID NO: 6736 - RNA, 19 nt, artificial
  Chemically synthesized
uucuggacuaucaaguuua

SEQ ID NO: 6737 - RNA, 19 nt, artificial
  Chemically synthesized
gcuagaggcaggaaggaag

SEQ ID NO: 6738 - RNA, 19 nt, artificial
  Chemically synthesized
ugagaaacuugaccuuccu

SEQ ID NO: 6739 - RNA, 19 nt, artificial
  Chemically synthesized
ccaacaucauccaugaagg

SEQ ID NO: 6740 - RNA, 19 nt, artificial
  Chemically synthesized
cagaaguugaucuaccaag

SEQ ID NO: 6741 - RNA, 19 nt, artificial
  Chemically synthesized
uuccaaguagucuagcuuu

SEQ ID NO: 6742 - RNA, 19 nt, artificial
  Chemically synthesized
agccgcugguguaucuuug

SEQ ID NO: 6743 - RNA, 19 nt, artificial
  Chemically synthesized
guuguagcaguucuggucu

SEQ ID NO: 6744 - RNA, 19 nt, artificial
  Chemically synthesized
cuggcaguuucugagcagu

SEQ ID NO: 6745 - RNA, 19 nt, artificial
  Chemically synthesized
agaggcagcucuuggugga

SEQ ID NO: 6746 - RNA, 19 nt, artificial
  Chemically synthesized
guguguauuugaaagugug

SEQ ID NO: 6747 - RNA, 19 nt, artificial
  Chemically synthesized
ccagcaacaagauucaaag

SEQ ID NO: 6748 - RNA, 19 nt, artificial
  Chemically synthesized
guuuguuacugaguguuuc

SEQ ID NO: 6749 - RNA, 19 nt, artificial
  Chemically synthesized
cuaucugaagaggaaaaau

SEQ ID NO: 6750 - RNA, 19 nt, artificial
  Chemically synthesized
auguacuagugaaaguaga

SEQ ID NO: 6751 - RNA, 19 nt, artificial
  Chemically synthesized
aucuaccaagccuugaguu

SEQ ID NO: 6752 - RNA, 19 nt, artificial
  Chemically synthesized
cgguccucagugugcuugu

SEQ ID NO: 6753 - RNA, 19 nt, artificial
  Chemically synthesized
guccagaaugcuaagguug

SEQ ID NO: 6754 - RNA, 19 nt, artificial
  Chemically synthesized
gcuguguguauuugaaagu

SEQ ID NO: 6755 - RNA, 19 nt, artificial
  Chemically synthesized
guuuccugcaauggaucaa

SEQ ID NO: 6756 - RNA, 19 nt, artificial
  Chemically synthesized
guuuucaguauuccuauca

SEQ ID NO: 6757 - RNA, 19 nt, artificial
  Chemically synthesized
cuguuguagcaguucuggu

SEQ ID NO: 6758 - RNA, 19 nt, artificial
  Chemically synthesized
gagccuaagccaccucucu

SEQ ID NO: 6759 - RNA, 19 nt, artificial
  Chemically synthesized
ccuucagauaagcagggca

SEQ ID NO: 6760 - RNA, 19 nt, artificial
  Chemically synthesized
aaauccagacaauugaaga

SEQ ID NO: 6761 - RNA, 19 nt, artificial
  Chemically synthesized
agucucaaucacauaauga

SEQ ID NO: 6762 - RNA, 19 nt, artificial
  Chemically synthesized
guucuuauaaagaagguuc

SEQ ID NO: 6763 - RNA, 19 nt, artificial
  Chemically synthesized
agcugguggcuguggagac

SEQ ID NO: 6764 - RNA, 19 nt, artificial
  Chemically synthesized
ccucucacccuuuagccca

SEQ ID NO: 6765 - RNA, 19 nt, artificial
  Chemically synthesized
aggugauuguugugguguc

SEQ ID NO: 6766 - RNA, 19 nt, artificial
  Chemically synthesized
gaaggaagugggaugaccu

SEQ ID NO: 6767 - RNA, 19 nt, artificial
  Chemically synthesized
accauugaagaauuccgau

SEQ ID NO: 6768 - RNA, 19 nt, artificial
  Chemically synthesized
auggcaucuucaauggcuu

SEQ ID NO: 6769 - RNA, 19 nt, artificial
  Chemically synthesized
gucgguccucagugugcuu

SEQ ID NO: 6770 - RNA, 19 nt, artificial
  Chemically synthesized
acagcauuuuccaaguagu

SEQ ID NO: 6771 - RNA, 19 nt, artificial
  Chemically synthesized
gagcugagaaacuugaccu

SEQ ID NO: 6772 - RNA, 19 nt, artificial
  Chemically synthesized
cagggcuguguguauuuga

SEQ ID NO: 6773 - RNA, 19 nt, artificial
  Chemically synthesized
ccuuccagauaucuucaca

SEQ ID NO: 6774 - RNA, 19 nt, artificial
  Chemically synthesized
uggaccucugaaucucuuu

SEQ ID NO: 6775 - RNA, 19 nt, artificial
  Chemically synthesized
caacagcauuuaacucacu

SEQ ID NO: 6776 - RNA, 19 nt, artificial
  Chemically synthesized
uauccaaccaggugcauuu

SEQ ID NO: 6777 - RNA, 19 nt, artificial
  Chemically synthesized
agucuucagguacuaaaua

SEQ ID NO: 6778 - RNA, 19 nt, artificial
  Chemically synthesized
aguuucuagaucucaguag

SEQ ID NO: 6779 - RNA, 19 nt, artificial
  Chemically synthesized
ugcaauuggcaggaagcaa

SEQ ID NO: 6780 - RNA, 19 nt, artificial
  Chemically synthesized
gggcggcacaucuucugga

SEQ ID NO: 6781 - RNA, 19 nt, artificial
  Chemically synthesized
ccagccuaaaguauuuaga

SEQ ID NO: 6782 - RNA, 19 nt, artificial
  Chemically synthesized
guauuauguuauagccauc

SEQ ID NO: 6783 - RNA, 19 nt, artificial
  Chemically synthesized
gauguuugauggaccucug

SEQ ID NO: 6784 - RNA, 19 nt, artificial
  Chemically synthesized
uggacaguuucccacauug

SEQ ID NO: 6785 - RNA, 19 nt, artificial
  Chemically synthesized
augaaggaaacuuggaaaa

SEQ ID NO: 6786 - RNA, 19 nt, artificial
  Chemically synthesized
agcauuccaauuugaaaca

SEQ ID NO: 6787 - RNA, 19 nt, artificial
  Chemically synthesized
aauuucggauggcaacauu

SEQ ID NO: 6788 - RNA, 19 nt, artificial
  Chemically synthesized
uguuauuaccaugaguuca

SEQ ID NO: 6789 - RNA, 19 nt, artificial
  Chemically synthesized
aguguguguguccgcauga

SEQ ID NO: 6790 - RNA, 19 nt, artificial
  Chemically synthesized
caugacaaagaaagucauu

SEQ ID NO: 6791 - RNA, 19 nt, artificial
  Chemically synthesized
guauuuuucuaaucugacc

SEQ ID NO: 6792 - RNA, 19 nt, artificial
  Chemically synthesized
agagaaacaaaaguccaga

SEQ ID NO: 6793 - RNA, 19 nt, artificial
  Chemically synthesized
cuuuauccaaccaggugca

SEQ ID NO: 6794 - RNA, 19 nt, artificial
  Chemically synthesized
guguuugguuugagcaggu

SEQ ID NO: 6795 - RNA, 19 nt, artificial
  Chemically synthesized
uacguuuccuuauaagugu

SEQ ID NO: 6796 - RNA, 19 nt, artificial
  Chemically synthesized
gucuugccuauaagcuaau

SEQ ID NO: 6797 - RNA, 19 nt, artificial
  Chemically synthesized
cuuccucuccugcgugaga

SEQ ID NO: 6798 - RNA, 19 nt, artificial
  Chemically synthesized
agucuuccaggugggcauu

SEQ ID NO: 6799 - RNA, 19 nt, artificial
  Chemically synthesized
aaccaacucagucaaggaa

SEQ ID NO: 6800 - RNA, 19 nt, artificial
  Chemically synthesized
cugagaaacuugaccuucc

SEQ ID NO: 6801 - RNA, 19 nt, artificial
  Chemically synthesized
uuucaguauuccuaucacu

SEQ ID NO: 6802 - RNA, 19 nt, artificial
  Chemically synthesized
ucauuguccugcagaaggu

SEQ ID NO: 6803 - RNA, 19 nt, artificial
  Chemically synthesized
aaugaaggaaacuuggaaa

SEQ ID NO: 6804 - RNA, 19 nt, artificial
  Chemically synthesized
uucuggucuauaaguucua

SEQ ID NO: 6805 - RNA, 19 nt, artificial
  Chemically synthesized
acugaguguuucagagugu

SEQ ID NO: 6806 - RNA, 19 nt, artificial
  Chemically synthesized
gugggaaugcuuuuucaga

SEQ ID NO: 6807 - RNA, 19 nt, artificial
  Chemically synthesized
cucagugucaacuggagca

SEQ ID NO: 6808 - RNA, 19 nt, artificial
  Chemically synthesized
gggcauaucagagccuaag

SEQ ID NO: 6809 - RNA, 19 nt, artificial
  Chemically synthesized
ccaacagcauuuaacucac

SEQ ID NO: 6810 - RNA, 19 nt, artificial
  Chemically synthesized
ucagaaguugaucuaccaa

SEQ ID NO: 6811 - RNA, 19 nt, artificial
  Chemically synthesized
ucuccugugacaaaagaga

SEQ ID NO: 6812 - RNA, 19 nt, artificial
  Chemically synthesized
guuuucuucuucuaacuuc

SEQ ID NO: 6813 - RNA, 19 nt, artificial
  Chemically synthesized
cuguuugagaugaguucuc

SEQ ID NO: 6814 - RNA, 19 nt, artificial
  Chemically synthesized
aucuuacucagaaugacuu

SEQ ID NO: 6815 - RNA, 19 nt, artificial
  Chemically synthesized
acucagucaaggaacccau

SEQ ID NO: 6816 - RNA, 19 nt, artificial
  Chemically synthesized
cagcaacaagauucaaagu

SEQ ID NO: 6817 - RNA, 19 nt, artificial
  Chemically synthesized
caauggaucaaggaccaga

SEQ ID NO: 6818 - RNA, 19 nt, artificial
  Chemically synthesized
cuugguggaaguugaacga

SEQ ID NO: 6819 - RNA, 19 nt, artificial
  Chemically synthesized
cugugacaaaagagauaac

SEQ ID NO: 6820 - RNA, 19 nt, artificial
  Chemically synthesized
acuuggaaaaguuugacaa

SEQ ID NO: 6821 - RNA, 19 nt, artificial
  Chemically synthesized
augcuuuuucagaaguuga

SEQ ID NO: 6822 - RNA, 19 nt, artificial
  Chemically synthesized
ucaguugucaaaacuggaa

SEQ ID NO: 6823 - RNA, 19 nt, artificial
  Chemically synthesized
uguucuuuuccugagucuu

SEQ ID NO: 6824 - RNA, 19 nt, artificial
  Chemically synthesized
cauuuugggaagaguggau

SEQ ID NO: 6825 - RNA, 19 nt, artificial
  Chemically synthesized
ucuucuucuaacuuccucu

SEQ ID NO: 6826 - RNA, 19 nt, artificial
  Chemically synthesized
agacaacaaaauucaguug

SEQ ID NO: 6827 - RNA, 19 nt, artificial
  Chemically synthesized
auuuccgcuuccuggucuu

SEQ ID NO: 6828 - RNA, 19 nt, artificial
  Chemically synthesized
ucucuacucuugugcuugu

SEQ ID NO: 6829 - RNA, 19 nt, artificial
  Chemically synthesized
cuguauagaagagagugug

SEQ ID NO: 6830 - RNA, 19 nt, artificial
  Chemically synthesized
ugauagcgagccacgcauu

SEQ ID NO: 6831 - RNA, 19 nt, artificial
  Chemically synthesized
gcucuagagggccugugca

SEQ ID NO: 6832 - RNA, 19 nt, artificial
  Chemically synthesized
accagaguuuccugcaaug

SEQ ID NO: 6833 - RNA, 19 nt, artificial
  Chemically synthesized
agaaacagaacauucaaga

SEQ ID NO: 6834 - RNA, 19 nt, artificial
  Chemically synthesized
aacuggguguucacuuuuu

SEQ ID NO: 6835 - RNA, 19 nt, artificial
  Chemically synthesized
ccaucauuggugugucggu

SEQ ID NO: 6836 - RNA, 19 nt, artificial
  Chemically synthesized
auuuggacaguuucccaca

SEQ ID NO: 6837 - RNA, 19 nt, artificial
  Chemically synthesized
aguaugguagaggugaaaa

SEQ ID NO: 6838 - RNA, 19 nt, artificial
  Chemically synthesized
agcgagccacgcauucaca

SEQ ID NO: 6839 - RNA, 19 nt, artificial
  Chemically synthesized
aggaaacuuggaaaaguuu

SEQ ID NO: 6840 - RNA, 19 nt, artificial
  Chemically synthesized
ggaaaccugauuaacacau

SEQ ID NO: 6841 - RNA, 19 nt, artificial
  Chemically synthesized
uugcggguucuacaucaaa

SEQ ID NO: 6842 - RNA, 19 nt, artificial
  Chemically synthesized
ugaacccuaugaacuuuau

SEQ ID NO: 6843 - RNA, 19 nt, artificial
  Chemically synthesized
ugauuguugugguguccca

SEQ ID NO: 6844 - RNA, 19 nt, artificial
  Chemically synthesized
aaaacaaugugucuggaau

SEQ ID NO: 6845 - RNA, 19 nt, artificial
  Chemically synthesized
uaucuguuguagcaguucu

SEQ ID NO: 6846 - RNA, 19 nt, artificial
  Chemically synthesized
ccucaugaaaugaguugca

SEQ ID NO: 6847 - RNA, 19 nt, artificial
  Chemically synthesized
ucuccugcgugagaccaga

SEQ ID NO: 6848 - RNA, 19 nt, artificial
  Chemically synthesized
gugcauuugugcacauauc

SEQ ID NO: 6849 - RNA, 19 nt, artificial
  Chemically synthesized
cccuauguaucccuaucag

SEQ ID NO: 6850 - RNA, 19 nt, artificial
  Chemically synthesized
uagacuacuaccucgauga

SEQ ID NO: 6851 - RNA, 19 nt, artificial
  Chemically synthesized
ggaaaacuuccuuccagau

SEQ ID NO: 6852 - RNA, 19 nt, artificial
  Chemically synthesized
aaauaugaccacagucaga

SEQ ID NO: 6853 - RNA, 19 nt, artificial
  Chemically synthesized
ucccuauguaucccuauca

SEQ ID NO: 6854 - RNA, 19 nt, artificial
  Chemically synthesized
cuaucaaguuuacagaagc

SEQ ID NO: 6855 - RNA, 19 nt, artificial
  Chemically synthesized
gaagaguggauguuaucau

SEQ ID NO: 6856 - RNA, 19 nt, artificial
  Chemically synthesized
gucucaaucacauaaugac

SEQ ID NO: 6857 - RNA, 19 nt, artificial
  Chemically synthesized
ccauggugcacuagauaug

SEQ ID NO: 6858 - RNA, 19 nt, artificial
  Chemically synthesized
agucaaggaacccaugaca

SEQ ID NO: 6859 - RNA, 19 nt, artificial
  Chemically synthesized
gaggcagcucuugguggaa

SEQ ID NO: 6860 - RNA, 19 nt, artificial
  Chemically synthesized
cuugcuggcugcauaaagu

SEQ ID NO: 6861 - RNA, 19 nt, artificial
  Chemically synthesized
gugaaaacaucuaugaugc

SEQ ID NO: 6862 - RNA, 19 nt, artificial
  Chemically synthesized
ggcugcuaaucucaaggag

SEQ ID NO: 6863 - RNA, 19 nt, artificial
  Chemically synthesized
ggcugggacucugauccca

SEQ ID NO: 6864 - RNA, 19 nt, artificial
  Chemically synthesized
gugaguaauuccauggugc

SEQ ID NO: 6865 - RNA, 19 nt, artificial
  Chemically synthesized
guuucagaguguguuuggu

SEQ ID NO: 6866 - RNA, 19 nt, artificial
  Chemically synthesized
aguuuucaguauuccuauc

SEQ ID NO: 6867 - RNA, 19 nt, artificial
  Chemically synthesized
ugcuguuuccuguugggca

SEQ ID NO: 6868 - RNA, 19 nt, artificial
  Chemically synthesized
ggcuuagaacaacuagaac

SEQ ID NO: 6869 - RNA, 19 nt, artificial
  Chemically synthesized
aagguucccagaaaagaau

SEQ ID NO: 6870 - RNA, 19 nt, artificial
  Chemically synthesized
agaaagucauuucaacucu

SEQ ID NO: 6871 - RNA, 19 nt, artificial
  Chemically synthesized
uuaagacgugcuucaaaua

SEQ ID NO: 6872 - RNA, 19 nt, artificial
  Chemically synthesized
cugugcaauuugaccauug

SEQ ID NO: 6873 - RNA, 19 nt, artificial
  Chemically synthesized
aaaggaggaagggagaaau

SEQ ID NO: 6874 - RNA, 19 nt, artificial
  Chemically synthesized
augucaggccuuaugcuaa

SEQ ID NO: 6875 - RNA, 19 nt, artificial
  Chemically synthesized
cccugcguggaggugugaa

SEQ ID NO: 6876 - RNA, 19 nt, artificial
  Chemically synthesized
cuuguacuugugaacacca

SEQ ID NO: 6877 - RNA, 19 nt, artificial
  Chemically synthesized
caggugggcauuucaacca

SEQ ID NO: 6878 - RNA, 19 nt, artificial
  Chemically synthesized
uucagaacaagugauguuu

SEQ ID NO: 6879 - RNA, 19 nt, artificial
  Chemically synthesized
ugcuuuuucagaaguugau

SEQ ID NO: 6880 - RNA, 19 nt, artificial
  Chemically synthesized
gcaggaaggaagugggaug

SEQ ID NO: 6881 - RNA, 19 nt, artificial
  Chemically synthesized
auacauugcuguuuccugu

SEQ ID NO: 6882 - RNA, 19 nt, artificial
  Chemically synthesized
cugaccaaucuagagcacu

SEQ ID NO: 6883 - RNA, 19 nt, artificial
  Chemically synthesized
ugcuuguaguaucuguugu

SEQ ID NO: 6884 - RNA, 19 nt, artificial
  Chemically synthesized
caaaucuagcaucucuaga

SEQ ID NO: 6885 - RNA, 19 nt, artificial
  Chemically synthesized
ucggauggcaacauuuaga

SEQ ID NO: 6886 - RNA, 19 nt, artificial
  Chemically synthesized
cauuuucccuggugagugu

SEQ ID NO: 6887 - RNA, 19 nt, artificial
  Chemically synthesized
caaguuuacagaagcuggu

SEQ ID NO: 6888 - RNA, 19 nt, artificial
  Chemically synthesized
cagagacuuuauucccggu

SEQ ID NO: 6889 - RNA, 19 nt, artificial
  Chemically synthesized
uggguguguuuccaugucu

SEQ ID NO: 6890 - RNA, 19 nt, artificial
  Chemically synthesized
cuccucagaaacagaacau

SEQ ID NO: 6891 - RNA, 19 nt, artificial
  Chemically synthesized
cacaccagaguugcuuuca

SEQ ID NO: 6892 - RNA, 19 nt, artificial
  Chemically synthesized
aucuaugaugccuuuguua

SEQ ID NO: 6893 - RNA, 19 nt, artificial
  Chemically synthesized
cguggaggugugaaaucca

SEQ ID NO: 6894 - RNA, 19 nt, artificial
  Chemically synthesized
uaaauaugagccacaacaa

SEQ ID NO: 6895 - RNA, 19 nt, artificial
  Chemically synthesized
gaacuuuauccaaccaggu

SEQ ID NO: 6896 - RNA, 19 nt, artificial
  Chemically synthesized
aggaaaacuuccuuccaga

SEQ ID NO: 6897 - RNA, 19 nt, artificial
  Chemically synthesized
aguucucuacucuugugcu

SEQ ID NO: 6898 - RNA, 19 nt, artificial
  Chemically synthesized
ccucagaaacagaacauuc

SEQ ID NO: 6899 - RNA, 19 nt, artificial
  Chemically synthesized
uauuccuaucacucagaaa

SEQ ID NO: 6900 - RNA, 19 nt, artificial
  Chemically synthesized
uugcuguucucaaagugau

SEQ ID NO: 6901 - RNA, 19 nt, artificial
  Chemically synthesized
acaaaggugggaaugcuuu

SEQ ID NO: 6902 - RNA, 19 nt, artificial
  Chemically synthesized
gaauguucauccagccucc

SEQ ID NO: 6903 - RNA, 19 nt, artificial
  Chemically synthesized
ccuaucagggcugugugua

SEQ ID NO: 6904 - RNA, 19 nt, artificial
  Chemically synthesized
uuucaaagguugcuguucu

SEQ ID NO: 6905 - RNA, 19 nt, artificial
  Chemically synthesized
ugguguaucuuugaauaug

SEQ ID NO: 6906 - RNA, 19 nt, artificial
  Chemically synthesized
cauccagaguuuagcccug

SEQ ID NO: 6907 - RNA, 19 nt, artificial
  Chemically synthesized
uacagaagcugguggcugu

SEQ ID NO: 6908 - RNA, 19 nt, artificial
  Chemically synthesized
ccugucagaugaauaagac

SEQ ID NO: 6909 - RNA, 19 nt, artificial
  Chemically synthesized
auagggaguugucuaauug

SEQ ID NO: 6910 - RNA, 19 nt, artificial
  Chemically synthesized
uuuaagacgugcuucaaau

SEQ ID NO: 6911 - RNA, 19 nt, artificial
  Chemically synthesized
aucucaguagaaauggcuu

SEQ ID NO: 6912 - RNA, 19 nt, artificial
  Chemically synthesized
agaagcugguggcugugga

SEQ ID NO: 6913 - RNA, 19 nt, artificial
  Chemically synthesized
ucaaggagcuuccagugca

SEQ ID NO: 6914 - RNA, 19 nt, artificial
  Chemically synthesized
cuggugagugugacuauug

SEQ ID NO: 6915 - RNA, 19 nt, artificial
  Chemically synthesized
uauucaaggcagggaguau

SEQ ID NO: 6916 - RNA, 19 nt, artificial
  Chemically synthesized
ucacagagcugagaaacuu

SEQ ID NO: 6917 - RNA, 19 nt, artificial
  Chemically synthesized
uccuggucauucucgagca

SEQ ID NO: 6918 - RNA, 19 nt, artificial
  Chemically synthesized
ggaaacuuggaaaaguuug

SEQ ID NO: 6919 - RNA, 19 nt, artificial
  Chemically synthesized
acaacuagaacaucuggau

SEQ ID NO: 6920 - RNA, 19 nt, artificial
  Chemically synthesized
cuucagauaagcagggcau

SEQ ID NO: 6921 - RNA, 19 nt, artificial
  Chemically synthesized
auaugagccacaacaacuu

SEQ ID NO: 6922 - RNA, 19 nt, artificial
  Chemically synthesized
guguccgcaugaucauauc

SEQ ID NO: 6923 - RNA, 19 nt, artificial
  Chemically synthesized
gaggugugaaauccagaca

SEQ ID NO: 6924 - RNA, 19 nt, artificial
  Chemically synthesized
ucuccagucuucagguacu

SEQ ID NO: 6925 - RNA, 19 nt, artificial
  Chemically synthesized
gguacuaaauaugagccac

SEQ ID NO: 6926 - RNA, 19 nt, artificial
  Chemically synthesized
aguuauugccuacuaagua

SEQ ID NO: 6927 - RNA, 19 nt, artificial
  Chemically synthesized
cuggauuuccagcauucca

SEQ ID NO: 6928 - RNA, 19 nt, artificial
  Chemically synthesized
gaacuggguguucacuuuu

SEQ ID NO: 6929 - RNA, 19 nt, artificial
  Chemically synthesized
gaacaagugauguuugaug

SEQ ID NO: 6930 - RNA, 19 nt, artificial
  Chemically synthesized
cgcuuccuggucuuaucau

SEQ ID NO: 6931 - RNA, 19 nt, artificial
  Chemically synthesized
uucuggagacgacucagaa

SEQ ID NO: 6932 - RNA, 19 nt, artificial
  Chemically synthesized
acaaaugagugaguuuuca

SEQ ID NO: 6933 - RNA, 19 nt, artificial
  Chemically synthesized
agguuguuuaagacgugcu

SEQ ID NO: 6934 - RNA, 19 nt, artificial
  Chemically synthesized
gcagggaguauacauugcu

SEQ ID NO: 6935 - RNA, 19 nt, artificial
  Chemically synthesized
ugcugcucacagaagcagu

SEQ ID NO: 6936 - RNA, 19 nt, artificial
  Chemically synthesized
guauuuagaucugagcuuc

SEQ ID NO: 6937 - RNA, 19 nt, artificial
  Chemically synthesized
gaaacaaaaguccagaaug

SEQ ID NO: 6938 - RNA, 19 nt, artificial
  Chemically synthesized
gaggaugaugccaggauga

SEQ ID NO: 6939 - RNA, 19 nt, artificial
  Chemically synthesized
gucacuuugucacucgaug

SEQ ID NO: 6940 - RNA, 19 nt, artificial
  Chemically synthesized
uuccucuccugugacaaaa

SEQ ID NO: 6941 - RNA, 19 nt, artificial
  Chemically synthesized
auaucuguauagaagagag

SEQ ID NO: 6942 - RNA, 19 nt, artificial
  Chemically synthesized
gaauaugagauugcucaga

SEQ ID NO: 6943 - RNA, 19 nt, artificial
  Chemically synthesized
accucgaugauauuauuga

SEQ ID NO: 6944 - RNA, 19 nt, artificial
  Chemically synthesized
caaaguauuuauugcacag

SEQ ID NO: 6945 - RNA, 19 nt, artificial
  Chemically synthesized
gaaaacuuguauucaaggu

SEQ ID NO: 6946 - RNA, 19 nt, artificial
  Chemically synthesized
gugugaagguauucaaggc

SEQ ID NO: 6947 - RNA, 19 nt, artificial
  Chemically synthesized
agaaaaggacaaucaggau

SEQ ID NO: 6948 - RNA, 19 nt, artificial
  Chemically synthesized
cuugauuacagucucaauc

SEQ ID NO: 6949 - RNA, 19 nt, artificial
  Chemically synthesized
ucagaaugacuuugcuugu

SEQ ID NO: 6950 - RNA, 19 nt, artificial
  Chemically synthesized
ccuggguguguuuccaugu

SEQ ID NO: 6951 - RNA, 19 nt, artificial
  Chemically synthesized
aaugagugaguuuucagua

SEQ ID NO: 6952 - RNA, 19 nt, artificial
  Chemically synthesized
ucuuacucagaaugacuuu

SEQ ID NO: 6953 - RNA, 19 nt, artificial
  Chemically synthesized
aggguaaaagacuuuucuu

SEQ ID NO: 6954 - RNA, 19 nt, artificial
  Chemically synthesized
aauccagacaauugaagau

SEQ ID NO: 6955 - RNA, 19 nt, artificial
  Chemically synthesized
cagaagcagugaggaugau

SEQ ID NO: 6956 - RNA, 19 nt, artificial
  Chemically synthesized
uugaaaggguaaaagacuu

SEQ ID NO: 6957 - RNA, 19 nt, artificial
  Chemically synthesized
guugaucuaccaagccuug

SEQ ID NO: 6958 - RNA, 19 nt, artificial
  Chemically synthesized
gggagacacagauggcugg

SEQ ID NO: 6959 - RNA, 19 nt, artificial
  Chemically synthesized
cuagaucucaguagaaaug

SEQ ID NO: 6960 - RNA, 19 nt, artificial
  Chemically synthesized
ggaugaccucaggagguca

SEQ ID NO: 6961 - RNA, 19 nt, artificial
  Chemically synthesized
ccuuuccagcaacaagauu

SEQ ID NO: 6962 - RNA, 19 nt, artificial
  Chemically synthesized
ucacaaccauccuggucau

SEQ ID NO: 6963 - RNA, 19 nt, artificial
  Chemically synthesized
gcaauuggcaggaagcaac

SEQ ID NO: 6964 - RNA, 19 nt, artificial
  Chemically synthesized
ggcaggaaggaagugggau

SEQ ID NO: 6965 - RNA, 19 nt, artificial
  Chemically synthesized
acgaauggaaugugcaaca

SEQ ID NO: 6966 - RNA, 19 nt, artificial
  Chemically synthesized
cuggcaauucuuuccagga

SEQ ID NO: 6967 - RNA, 19 nt, artificial
  Chemically synthesized
cacuggucugcaggcguuu

SEQ ID NO: 6968 - RNA, 19 nt, artificial
  Chemically synthesized
guggugucccagcacuuca

SEQ ID NO: 6969 - RNA, 19 nt, artificial
  Chemically synthesized
uucucgagcauguucuauu

SEQ ID NO: 6970 - RNA, 19 nt, artificial
  Chemically synthesized
uggaaaaguuugacaaauc

SEQ ID NO: 6971 - RNA, 19 nt, artificial
  Chemically synthesized
aguggcuaauuccuaagga

SEQ ID NO: 6972 - RNA, 19 nt, artificial
  Chemically synthesized
aggucaccuuuucuugauu

SEQ ID NO: 6973 - RNA, 19 nt, artificial
  Chemically synthesized
gauugaacaucccugggug

SEQ ID NO: 6974 - RNA, 19 nt, artificial
  Chemically synthesized
agacuacuaccucgaugau

SEQ ID NO: 6975 - RNA, 19 nt, artificial
  Chemically synthesized
uugguucugggagaauuua

SEQ ID NO: 6976 - RNA, 19 nt, artificial
  Chemically synthesized
cauaucuguauagaagaga

SEQ ID NO: 6977 - RNA, 19 nt, artificial
  Chemically synthesized
uucuuuuccugagucuuuu

SEQ ID NO: 6978 - RNA, 19 nt, artificial
  Chemically synthesized
agacgugcuucaaauaucc

SEQ ID NO: 6979 - RNA, 19 nt, artificial
  Chemically synthesized
ccugcagaagguggagaag

SEQ ID NO: 6980 - RNA, 19 nt, artificial
  Chemically synthesized
ucuggucuauaaguucuau

SEQ ID NO: 6981 - RNA, 19 nt, artificial
  Chemically synthesized
auuucaacucuuaccucau

SEQ ID NO: 6982 - RNA, 19 nt, artificial
  Chemically synthesized
cuuuucauuggauacguuu

SEQ ID NO: 6983 - RNA, 19 nt, artificial
  Chemically synthesized
aguugaacgaauggaaugu

SEQ ID NO: 6984 - RNA, 19 nt, artificial
  Chemically synthesized
cauuucagcucugccuuca

SEQ ID NO: 6985 - RNA, 19 nt, artificial
  Chemically synthesized
cuguuuccuguugggcaau

SEQ ID NO: 6986 - RNA, 19 nt, artificial
  Chemically synthesized
gaauccagaaggaacagug

SEQ ID NO: 6987 - RNA, 19 nt, artificial
  Chemically synthesized
gucaugaaagcagcauuga

SEQ ID NO: 6988 - RNA, 19 nt, artificial
  Chemically synthesized
ccuaugaacuuuauccaac

SEQ ID NO: 6989 - RNA, 19 nt, artificial
  Chemically synthesized
cuacagcauuuuccaagua

SEQ ID NO: 6990 - RNA, 19 nt, artificial
  Chemically synthesized
cuguggagacaaaucuagc

SEQ ID NO: 6991 - RNA, 19 nt, artificial
  Chemically synthesized
agcuuccagugcagaggga

SEQ ID NO: 6992 - RNA, 19 nt, artificial
  Chemically synthesized
aggaacaguggguacagga

SEQ ID NO: 6993 - RNA, 19 nt, artificial
  Chemically synthesized
ucaacucuuaccucaucaa

SEQ ID NO: 6994 - RNA, 19 nt, artificial
  Chemically synthesized
ccacauuuugggaagagug

SEQ ID NO: 6995 - RNA, 19 nt, artificial
  Chemically synthesized
cuuuucuugauuccagaaa

SEQ ID NO: 6996 - RNA, 19 nt, artificial
  Chemically synthesized
guuucaaagguugcuguuc

SEQ ID NO: 6997 - RNA, 19 nt, artificial
  Chemically synthesized
gcucugccuucacuacaga

SEQ ID NO: 6998 - RNA, 19 nt, artificial
  Chemically synthesized
ugcuaaucucaaggagcuu

SEQ ID NO: 6999 - RNA, 19 nt, artificial
  Chemically synthesized
ugguguuauuaccaugagu

SEQ ID NO: 7000 - RNA, 19 nt, artificial
  Chemically synthesized
ucauguacuagugaaagua

SEQ ID NO: 7001 - RNA, 19 nt, artificial
  Chemically synthesized
acaaccagccuaaaguauu

SEQ ID NO: 7002 - RNA, 19 nt, artificial
  Chemically synthesized
uguacuagugaaaguagau

SEQ ID NO: 7003 - RNA, 19 nt, artificial
  Chemically synthesized
ucacaaucuuauccaaucu

SEQ ID NO: 7004 - RNA, 19 nt, artificial
  Chemically synthesized
guguaucuuugaauaugag

SEQ ID NO: 7005 - RNA, 19 nt, artificial
  Chemically synthesized
agcccugcguggaggugug

SEQ ID NO: 7006 - RNA, 19 nt, artificial
  Chemically synthesized
ccacauugaaacucaaauc

SEQ ID NO: 7007 - RNA, 19 nt, artificial
  Chemically synthesized
uuucaaccaacucagucaa

SEQ ID NO: 7008 - RNA, 19 nt, artificial
  Chemically synthesized
aaugcuccuugaccacauu

SEQ ID NO: 7009 - RNA, 19 nt, artificial
  Chemically synthesized
uccagcaacaagauucaaa

SEQ ID NO: 7010 - RNA, 19 nt, artificial
  Chemically synthesized
cggcucgaggaagagaaga

SEQ ID NO: 7011 - RNA, 19 nt, artificial
  Chemically synthesized
ccacagucagaaguguuug

SEQ ID NO: 7012 - RNA, 19 nt, artificial
  Chemically synthesized
aauggaaugugcaacaccu

SEQ ID NO: 7013 - RNA, 19 nt, artificial
  Chemically synthesized
aguacacucugucacuuug

SEQ ID NO: 7014 - RNA, 19 nt, artificial
  Chemically synthesized
acagaacauucaagaaaag

SEQ ID NO: 7015 - RNA, 19 nt, artificial
  Chemically synthesized
gacaacaaaauucaguugu

SEQ ID NO: 7016 - RNA, 19 nt, artificial
  Chemically synthesized
ucauaagcugacuuuaaga

SEQ ID NO: 7017 - RNA, 19 nt, artificial
  Chemically synthesized
aaauagggaguugucuaau

SEQ ID NO: 7018 - RNA, 19 nt, artificial
  Chemically synthesized
agccuaaaguauuuagauc

SEQ ID NO: 7019 - RNA, 19 nt, artificial
  Chemically synthesized
ccauuuugguaguuuugac

SEQ ID NO: 7020 - RNA, 19 nt, artificial
  Chemically synthesized
ucagugugcuuguaguauc

SEQ ID NO: 7021 - RNA, 19 nt, artificial
  Chemically synthesized
acagaaagagacauuguuc

SEQ ID NO: 7022 - RNA, 19 nt, artificial
  Chemically synthesized
cugccuucacuacagagac

SEQ ID NO: 7023 - RNA, 19 nt, artificial
  Chemically synthesized
cugaacuggguguucacuu

SEQ ID NO: 7024 - RNA, 19 nt, artificial
  Chemically synthesized
ugaaaggguaaaagacuuu

SEQ ID NO: 7025 - RNA, 19 nt, artificial
  Chemically synthesized
gggaagaguggauguuauc

SEQ ID NO: 7026 - RNA, 19 nt, artificial
  Chemically synthesized
gguggagaagacccugcuc

SEQ ID NO: 7027 - RNA, 19 nt, artificial
  Chemically synthesized
ggccauugcugccaacauc

SEQ ID NO: 7028 - RNA, 19 nt, artificial
  Chemically synthesized
aaaaggaggaagggagaaa

SEQ ID NO: 7029 - RNA, 19 nt, artificial
  Chemically synthesized
ugauuaacacaugcucaca

SEQ ID NO: 7030 - RNA, 19 nt, artificial
  Chemically synthesized
agccacaacaacuucuuuu

SEQ ID NO: 7031 - RNA, 19 nt, artificial
  Chemically synthesized
uccgcuuccuggucuuauc

SEQ ID NO: 7032 - RNA, 19 nt, artificial
  Chemically synthesized
agguucuugauuacagucu

SEQ ID NO: 7033 - RNA, 19 nt, artificial
  Chemically synthesized
gcacauaucccuauguauc

SEQ ID NO: 7034 - RNA, 19 nt, artificial
  Chemically synthesized
ugacugaacuggguguuca

SEQ ID NO: 7035 - RNA, 19 nt, artificial
  Chemically synthesized
auggcuguuugagaugagu

SEQ ID NO: 7036 - RNA, 19 nt, artificial
  Chemically synthesized
gaaaacaaugugucuggaa

SEQ ID NO: 7037 - RNA, 19 nt, artificial
  Chemically synthesized
auuuagaucugagcuucaa

SEQ ID NO: 7038 - RNA, 19 nt, artificial
  Chemically synthesized
aaacagaaagagacauugu

SEQ ID NO: 7039 - RNA, 19 nt, artificial
  Chemically synthesized
gggacucugaucccagcca

SEQ ID NO: 7040 - RNA, 19 nt, artificial
  Chemically synthesized
cacuuguucaguuaauaag

SEQ ID NO: 7041 - RNA, 19 nt, artificial
  Chemically synthesized
aacacaugcucacaaccau

SEQ ID NO: 7042 - RNA, 19 nt, artificial
  Chemically synthesized
uuugggacaaccagccuaa

SEQ ID NO: 7043 - RNA, 19 nt, artificial
  Chemically synthesized
caaggagcuuccagugcag

SEQ ID NO: 7044 - RNA, 19 nt, artificial
  Chemically synthesized
ugcugaguuugaauaucac

SEQ ID NO: 7045 - RNA, 19 nt, artificial
  Chemically synthesized
acuuucacuuccaacaaag

SEQ ID NO: 7046 - RNA, 19 nt, artificial
  Chemically synthesized
ugauuacagucucaaucac

SEQ ID NO: 7047 - RNA, 19 nt, artificial
  Chemically synthesized
cugcaggcguuuucuucuu

SEQ ID NO: 7048 - RNA, 19 nt, artificial
  Chemically synthesized
ggcuggcaauucuuuccag

SEQ ID NO: 7049 - RNA, 19 nt, artificial
  Chemically synthesized
caaggaaguauggaaaagu

SEQ ID NO: 7050 - RNA, 19 nt, artificial
  Chemically synthesized
caggccuuaugcuaagggu

SEQ ID NO: 7051 - RNA, 19 nt, artificial
  Chemically synthesized
accuuuccagcaacaagau

SEQ ID NO: 7052 - RNA, 19 nt, artificial
  Chemically synthesized
cauaucagagccuaagcca

SEQ ID NO: 7053 - RNA, 19 nt, artificial
  Chemically synthesized
cucgagcauguucuauuuu

SEQ ID NO: 7054 - RNA, 19 nt, artificial
  Chemically synthesized
uaccuugacauuucucaua

SEQ ID NO: 7055 - RNA, 19 nt, artificial
  Chemically synthesized
ugcuccuugaccacauuuu

SEQ ID NO: 7056 - RNA, 19 nt, artificial
  Chemically synthesized
cggcacaucuucuggagac

SEQ ID NO: 7057 - RNA, 19 nt, artificial
  Chemically synthesized
gcuucaaugguguuauuac

SEQ ID NO: 7058 - RNA, 19 nt, artificial
  Chemically synthesized
acuugaccuuccuggaccu

SEQ ID NO: 7059 - RNA, 19 nt, artificial
  Chemically synthesized
agucagaaguguuuguuac

SEQ ID NO: 7060 - RNA, 19 nt, artificial
  Chemically synthesized
agaauuccgauuagcauac

SEQ ID NO: 7061 - RNA, 19 nt, artificial
  Chemically synthesized
acucuccagucuucaggua

SEQ ID NO: 7062 - RNA, 19 nt, artificial
  Chemically synthesized
ugaacucccuccagguucu

SEQ ID NO: 7063 - RNA, 19 nt, artificial
  Chemically synthesized
ugugcuuguaguaucuguu

SEQ ID NO: 7064 - RNA, 19 nt, artificial
  Chemically synthesized
uaccucaucaaguugaaua

SEQ ID NO: 7065 - RNA, 19 nt, artificial
  Chemically synthesized
cuuagacuacuaccucgau

SEQ ID NO: 7066 - RNA, 19 nt, artificial
  Chemically synthesized
aguguguuugguuugagca

SEQ ID NO: 7067 - RNA, 19 nt, artificial
  Chemically synthesized
cagaaaagcccugcuggau

SEQ ID NO: 7068 - RNA, 19 nt, artificial
  Chemically synthesized
ugugcauuugugcacauau

SEQ ID NO: 7069 - RNA, 19 nt, artificial
  Chemically synthesized
agaccaucauugguguguc

SEQ ID NO: 7070 - RNA, 19 nt, artificial
  Chemically synthesized
gagcuguaccgccuucuca

SEQ ID NO: 7071 - RNA, 19 nt, artificial
  Chemically synthesized
ucuuuagaccugucccuga

SEQ ID NO: 7072 - RNA, 19 nt, artificial
  Chemically synthesized
cugguuuagaaguccaucg

SEQ ID NO: 7073 - RNA, 19 nt, artificial
  Chemically synthesized
acaucuggauuuccagcau

SEQ ID NO: 7074 - RNA, 19 nt, artificial
  Chemically synthesized
ccaagccuugaguuucuag

SEQ ID NO: 7075 - RNA, 19 nt, artificial
  Chemically synthesized
gugcuuguacaguagucuc

SEQ ID NO: 7076 - RNA, 19 nt, artificial
  Chemically synthesized
uagauuugucuccacagcc

SEQ ID NO: 7077 - RNA, 19 nt, artificial
  Chemically synthesized
uucauuucuaaauucuccc

SEQ ID NO: 7078 - RNA, 19 nt, artificial
  Chemically synthesized
auaccaauuagacaacucc

SEQ ID NO: 7079 - RNA, 19 nt, artificial
  Chemically synthesized
aaccuuugaaacucaagcc

SEQ ID NO: 7080 - RNA, 19 nt, artificial
  Chemically synthesized
uguucaaucacccuagacc

SEQ ID NO: 7081 - RNA, 19 nt, artificial
  Chemically synthesized
uaccaauuagacaacuccc

SEQ ID NO: 7082 - RNA, 19 nt, artificial
  Chemically synthesized
uagacaacucccuauuucc

SEQ ID NO: 7083 - RNA, 19 nt, artificial
  Chemically synthesized
ucuacugagaucuagaaac

SEQ ID NO: 7084 - RNA, 19 nt, artificial
  Chemically synthesized
uuucucaaugauaacaucc

SEQ ID NO: 7085 - RNA, 19 nt, artificial
  Chemically synthesized
uucaauagucacacucacc

SEQ ID NO: 7086 - RNA, 19 nt, artificial
  Chemically synthesized
uuggauaagauugugagcc

SEQ ID NO: 7087 - RNA, 19 nt, artificial
  Chemically synthesized
aaauuguccaugauaagac

SEQ ID NO: 7088 - RNA, 19 nt, artificial
  Chemically synthesized
uauaaucacacucucuucu

SEQ ID NO: 7089 - RNA, 19 nt, artificial
  Chemically synthesized
uauaccaauuagacaacuc

SEQ ID NO: 7090 - RNA, 19 nt, artificial
  Chemically synthesized
uuuccuggaaagaauugcc

SEQ ID NO: 7091 - RNA, 19 nt, artificial
  Chemically synthesized
uauucaaagcaguucuggg

SEQ ID NO: 7092 - RNA, 19 nt, artificial
  Chemically synthesized
uauacagauaugaucaugc

SEQ ID NO: 7093 - RNA, 19 nt, artificial
  Chemically synthesized
uagagaacucaucucaaac

SEQ ID NO: 7094 - RNA, 19 nt, artificial
  Chemically synthesized
uguagaacccgcaagucug

SEQ ID NO: 7095 - RNA, 19 nt, artificial
  Chemically synthesized
uucuuuacuagcucauucc

SEQ ID NO: 7096 - RNA, 19 nt, artificial
  Chemically synthesized
aucucaaacagccauagac

SEQ ID NO: 7097 - RNA, 19 nt, artificial
  Chemically synthesized
auugucuggauuucacacc

SEQ ID NO: 7098 - RNA, 19 nt, artificial
  Chemically synthesized
uauuaagguagagaggugg

SEQ ID NO: 7099 - RNA, 19 nt, artificial
  Chemically synthesized
agaucuagaaacucaaggc

SEQ ID NO: 7100 - RNA, 19 nt, artificial
  Chemically synthesized
uuugucuccacagccacca

SEQ ID NO: 7101 - RNA, 19 nt, artificial
  Chemically synthesized
uuagacaacucccuauuuc

SEQ ID NO: 7102 - RNA, 19 nt, artificial
  Chemically synthesized
uaaacuucugcugcaacuc

SEQ ID NO: 7103 - RNA, 19 nt, artificial
  Chemically synthesized
aaagucucuguagugaagg

SEQ ID NO: 7104 - RNA, 19 nt, artificial
  Chemically synthesized
uucuuuucugggaaccuuc

SEQ ID NO: 7105 - RNA, 19 nt, artificial
  Chemically synthesized
uucuaaaccagccagaccu

SEQ ID NO: 7106 - RNA, 19 nt, artificial
  Chemically synthesized
uacuguacaagcacaagag

SEQ ID NO: 7107 - RNA, 19 nt, artificial
  Chemically synthesized
uuucugaggaggcuggaug

SEQ ID NO: 7108 - RNA, 19 nt, artificial
  Chemically synthesized
uacucagguaauuugaaag

SEQ ID NO: 7109 - RNA, 19 nt, artificial
  Chemically synthesized
uuccuuaggaauuagccac

SEQ ID NO: 7110 - RNA, 19 nt, artificial
  Chemically synthesized
aacagcaauguauacuccc

SEQ ID NO: 7111 - RNA, 19 nt, artificial
  Chemically synthesized
ucaacuuccaccaagagcu

SEQ ID NO: 7112 - RNA, 19 nt, artificial
  Chemically synthesized
uuucacuaguacaugagac

SEQ ID NO: 7113 - RNA, 19 nt, artificial
  Chemically synthesized
aaaaaauagaacaugcucg

SEQ ID NO: 7114 - RNA, 19 nt, artificial
  Chemically synthesized
uugcccaacaggaaacagc

SEQ ID NO: 7115 - RNA, 19 nt, artificial
  Chemically synthesized
uuggaagugaaaguaagcc

SEQ ID NO: 7116 - RNA, 19 nt, artificial
  Chemically synthesized
auccauugcaggaaacucu

SEQ ID NO: 7117 - RNA, 19 nt, artificial
  Chemically synthesized
uuuccugucaauauuaagg

SEQ ID NO: 7118 - RNA, 19 nt, artificial
  Chemically synthesized
uuuuccuggaaagaauugc

SEQ ID NO: 7119 - RNA, 19 nt, artificial
  Chemically synthesized
uagacuacuuggaaaaugc

SEQ ID NO: 7120 - RNA, 19 nt, artificial
  Chemically synthesized
uuaagguagagagguggcu

SEQ ID NO: 7121 - RNA, 19 nt, artificial
  Chemically synthesized
uuuuggaagucauuaugug

SEQ ID NO: 7122 - RNA, 19 nt, artificial
  Chemically synthesized
uaagaaaagucuuuuaccc

SEQ ID NO: 7123 - RNA, 19 nt, artificial
  Chemically synthesized
uacaagcacacugaggacc

SEQ ID NO: 7124 - RNA, 19 nt, artificial
  Chemically synthesized
aaacuguccaaauuuacag

SEQ ID NO: 7125 - RNA, 19 nt, artificial
  Chemically synthesized
uucucuuccucgagccgcc

SEQ ID NO: 7126 - RNA, 19 nt, artificial
  Chemically synthesized
aaacagcaauguauacucc

SEQ ID NO: 7127 - RNA, 19 nt, artificial
  Chemically synthesized
uuaagaaagcuagacuacu

SEQ ID NO: 7128 - RNA, 19 nt, artificial
  Chemically synthesized
uacugagaucuagaaacuc

SEQ ID NO: 7129 - RNA, 19 nt, artificial
  Chemically synthesized
uugaguagauaacaaaggc

SEQ ID NO: 7130 - RNA, 19 nt, artificial
  Chemically synthesized
ugaguugguugaaaugccc

SEQ ID NO: 7131 - RNA, 19 nt, artificial
  Chemically synthesized
aagugcucuagauugguca

SEQ ID NO: 7132 - RNA, 19 nt, artificial
  Chemically synthesized
caaccuuugaaacucaagc

SEQ ID NO: 7133 - RNA, 19 nt, artificial
  Chemically synthesized
uuuuauggaaaccuucaug

SEQ ID NO: 7134 - RNA, 19 nt, artificial
  Chemically synthesized
uaaagagauucagaggucc

SEQ ID NO: 7135 - RNA, 19 nt, artificial
  Chemically synthesized
aauuguccaugauaagacc

SEQ ID NO: 7136 - RNA, 19 nt, artificial
  Chemically synthesized
auuugucuccacagccacc

SEQ ID NO: 7137 - RNA, 19 nt, artificial
  Chemically synthesized
aaaguaagccuuuugagag

SEQ ID NO: 7138 - RNA, 19 nt, artificial
  Chemically synthesized
uagagaugcuagauuuguc

SEQ ID NO: 7139 - RNA, 19 nt, artificial
  Chemically synthesized
uuuucugagucgucuccag

SEQ ID NO: 7140 - RNA, 19 nt, artificial
  Chemically synthesized
auuaauuccagacacauug

SEQ ID NO: 7141 - RNA, 19 nt, artificial
  Chemically synthesized
aauucucccagaaccaaac

SEQ ID NO: 7142 - RNA, 19 nt, artificial
  Chemically synthesized
auauaaucacacucucuuc

SEQ ID NO: 7143 - RNA, 19 nt, artificial
  Chemically synthesized
ugacuguggucauauuucc

SEQ ID NO: 7144 - RNA, 19 nt, artificial
  Chemically synthesized
aauuacucacccuuagcau

SEQ ID NO: 7145 - RNA, 19 nt, artificial
  Chemically synthesized
aguuagaagaagaaaacgc

SEQ ID NO: 7146 - RNA, 19 nt, artificial
  Chemically synthesized
uucaaugugggaaacuguc

SEQ ID NO: 7147 - RNA, 19 nt, artificial
  Chemically synthesized
ugucucuuucuguuuucuc

SEQ ID NO: 7148 - RNA, 19 nt, artificial
  Chemically synthesized
uggucaaggagcauugccc

SEQ ID NO: 7149 - RNA, 19 nt, artificial
  Chemically synthesized
uuuauagcuucauucagac

SEQ ID NO: 7150 - RNA, 19 nt, artificial
  Chemically synthesized
auguagaacccgcaagucu

SEQ ID NO: 7151 - RNA, 19 nt, artificial
  Chemically synthesized
ucacccuuagcauaaggcc

SEQ ID NO: 7152 - RNA, 19 nt, artificial
  Chemically synthesized
ugaaacucaagccauuucu

SEQ ID NO: 7153 - RNA, 19 nt, artificial
  Chemically synthesized
aacuuauagaccagaacug

SEQ ID NO: 7154 - RNA, 19 nt, artificial
  Chemically synthesized
uuacccuuucaauagucac

SEQ ID NO: 7155 - RNA, 19 nt, artificial
  Chemically synthesized
aaacucaagccauuucuac

SEQ ID NO: 7156 - RNA, 19 nt, artificial
  Chemically synthesized
gaacucaucucaaacagcc

SEQ ID NO: 7157 - RNA, 19 nt, artificial
  Chemically synthesized
auuucuacugagaucuaga

SEQ ID NO: 7158 - RNA, 19 nt, artificial
  Chemically synthesized
uaccuucacacguaguucu

SEQ ID NO: 7159 - RNA, 19 nt, artificial
  Chemically synthesized
uaguuaucucuuuugucac

SEQ ID NO: 7160 - RNA, 19 nt, artificial
  Chemically synthesized
uaaaugagguuucugagug

SEQ ID NO: 7161 - RNA, 19 nt, artificial
  Chemically synthesized
acuaauucuaaauguugcc

SEQ ID NO: 7162 - RNA, 19 nt, artificial
  Chemically synthesized
auugaaagcaacucuggug

SEQ ID NO: 7163 - RNA, 19 nt, artificial
  Chemically synthesized
auuugauguagaacccgca

SEQ ID NO: 7164 - RNA, 19 nt, artificial
  Chemically synthesized
uacaacagauacuacaagc

SEQ ID NO: 7165 - RNA, 19 nt, artificial
  Chemically synthesized
uucucugucuuuauucaac

SEQ ID NO: 7166 - RNA, 19 nt, artificial
  Chemically synthesized
acuuauagaccagaacugc

SEQ ID NO: 7167 - RNA, 19 nt, artificial
  Chemically synthesized
aaggcuugguagaucaacu

SEQ ID NO: 7168 - RNA, 19 nt, artificial
  Chemically synthesized
uauagcuucauucagacau

SEQ ID NO: 7169 - RNA, 19 nt, artificial
  Chemically synthesized
auaggaauacugaaaacuc

SEQ ID NO: 7170 - RNA, 19 nt, artificial
  Chemically synthesized
uguacuuuuccauacuucc

SEQ ID NO: 7171 - RNA, 19 nt, artificial
  Chemically synthesized
ugucuccacagccaccagc

SEQ ID NO: 7172 - RNA, 19 nt, artificial
  Chemically synthesized
uuuggaaugacaucgagug

SEQ ID NO: 7173 - RNA, 19 nt, artificial
  Chemically synthesized
augcccaccuggaagacuc

SEQ ID NO: 7174 - RNA, 19 nt, artificial
  Chemically synthesized
uagagcagauuugucaaac

SEQ ID NO: 7175 - RNA, 19 nt, artificial
  Chemically synthesized
aagaguagagaacucaucu

SEQ ID NO: 7176 - RNA, 19 nt, artificial
  Chemically synthesized
uugaagaugccauugaaag

SEQ ID NO: 7177 - RNA, 19 nt, artificial
  Chemically synthesized
uuccucauuucucccuucc

SEQ ID NO: 7178 - RNA, 19 nt, artificial
  Chemically synthesized
uauggauauuugaagcacg

SEQ ID NO: 7179 - RNA, 19 nt, artificial
  Chemically synthesized
acaacaaucaccuuucggc

SEQ ID NO: 7180 - RNA, 19 nt, artificial
  Chemically synthesized
uaacaaacacuucugacug

SEQ ID NO: 7181 - RNA, 19 nt, artificial
  Chemically synthesized
uuaucucuuuugucacagg

SEQ ID NO: 7182 - RNA, 19 nt, artificial
  Chemically synthesized
auagauguugcuuccugcc

SEQ ID NO: 7183 - RNA, 19 nt, artificial
  Chemically synthesized
uuucaaauacacacagccc

SEQ ID NO: 7184 - RNA, 19 nt, artificial
  Chemically synthesized
auuuucaagacuucgagac

SEQ ID NO: 7185 - RNA, 19 nt, artificial
  Chemically synthesized
uuuucugggaaccuucuuu

SEQ ID NO: 7186 - RNA, 19 nt, artificial
  Chemically synthesized
ugagacuguaaucaagaac

SEQ ID NO: 7187 - RNA, 19 nt, artificial
  Chemically synthesized
ugccucugguccuugaucc

SEQ ID NO: 7188 - RNA, 19 nt, artificial
  Chemically synthesized
auuuccauucaaaagacuc

SEQ ID NO: 7189 - RNA, 19 nt, artificial
  Chemically synthesized
acuguaaucaagaaccugg

SEQ ID NO: 7190 - RNA, 19 nt, artificial
  Chemically synthesized
uacagcuccaccugcugcc

SEQ ID NO: 7191 - RNA, 19 nt, artificial
  Chemically synthesized
auucagagguccaucaaac

SEQ ID NO: 7192 - RNA, 19 nt, artificial
  Chemically synthesized
auucuaaauguugccaucc

SEQ ID NO: 7193 - RNA, 19 nt, artificial
  Chemically synthesized
auggacuucuaaaccagcc

SEQ ID NO: 7194 - RNA, 19 nt, artificial
  Chemically synthesized
aauuagacaacucccuauu

SEQ ID NO: 7195 - RNA, 19 nt, artificial
  Chemically synthesized
aaaccuucauggaugaugu

SEQ ID NO: 7196 - RNA, 19 nt, artificial
  Chemically synthesized
aaccuuagcauucuggacu

SEQ ID NO: 7197 - RNA, 19 nt, artificial
  Chemically synthesized
uuauucaacuugaugaggu

SEQ ID NO: 7198 - RNA, 19 nt, artificial
  Chemically synthesized
aaugauggucuuauucauc

SEQ ID NO: 7199 - RNA, 19 nt, artificial
  Chemically synthesized
uaaagucucuguagugaag

SEQ ID NO: 7200 - RNA, 19 nt, artificial
  Chemically synthesized
ugacaggugauauucaaac

SEQ ID NO: 7201 - RNA, 19 nt, artificial
  Chemically synthesized
uguuggagacaacugcucc

SEQ ID NO: 7202 - RNA, 19 nt, artificial
  Chemically synthesized
uaugcuaaucggaauucuu

SEQ ID NO: 7203 - RNA, 19 nt, artificial
  Chemically synthesized
uucuucaauggucaaauug

SEQ ID NO: 7204 - RNA, 19 nt, artificial
  Chemically synthesized
uagacauccauuucaaaug

SEQ ID NO: 7205 - RNA, 19 nt, artificial
  Chemically synthesized
uuaaucagguuuccuuagg

SEQ ID NO: 7206 - RNA, 19 nt, artificial
  Chemically synthesized
auucaaacucagcacaggc

SEQ ID NO: 7207 - RNA, 19 nt, artificial
  Chemically synthesized
uuucuuugucauggguucc

SEQ ID NO: 7208 - RNA, 19 nt, artificial
  Chemically synthesized
ucaaaguuuugagaugucc

SEQ ID NO: 7209 - RNA, 19 nt, artificial
  Chemically synthesized
aaccuucuuuauaagaacc

SEQ ID NO: 7210 - RNA, 19 nt, artificial
  Chemically synthesized
ucaaucacccuagaccugc

SEQ ID NO: 7211 - RNA, 19 nt, artificial
  Chemically synthesized
auaccuucacacguaguuc

SEQ ID NO: 7212 - RNA, 19 nt, artificial
  Chemically synthesized
augauauuagcuuauaggc

SEQ ID NO: 7213 - RNA, 19 nt, artificial
  Chemically synthesized
aaucggaauucuucaaugg

SEQ ID NO: 7214 - RNA, 19 nt, artificial
  Chemically synthesized
aagcacgucuuaaacaacc

SEQ ID NO: 7215 - RNA, 19 nt, artificial
  Chemically synthesized
aagucugugcaauaaauac

SEQ ID NO: 7216 - RNA, 19 nt, artificial
  Chemically synthesized
uacuacaagcacacugagg

SEQ ID NO: 7217 - RNA, 19 nt, artificial
  Chemically synthesized
uuuuacccuuucaauaguc

SEQ ID NO: 7218 - RNA, 19 nt, artificial
  Chemically synthesized
ucaaacaucacuuguucug

SEQ ID NO: 7219 - RNA, 19 nt, artificial
  Chemically synthesized
ugcuguuggagacaacugc

SEQ ID NO: 7220 - RNA, 19 nt, artificial
  Chemically synthesized
ugaagguguugcacauucc

SEQ ID NO: 7221 - RNA, 19 nt, artificial
  Chemically synthesized
agucugugcaauaaauacu

SEQ ID NO: 7222 - RNA, 19 nt, artificial
  Chemically synthesized
uuccuuccugccucuagcc

SEQ ID NO: 7223 - RNA, 19 nt, artificial
  Chemically synthesized
uuucaaauuggaaugcugg

SEQ ID NO: 7224 - RNA, 19 nt, artificial
  Chemically synthesized
uucugcaggacaaugaaga

SEQ ID NO: 7225 - RNA, 19 nt, artificial
  Chemically synthesized
auuggaaugcuggaaaucc

SEQ ID NO: 7226 - RNA, 19 nt, artificial
  Chemically synthesized
ucuuguugcuggaaagguc

SEQ ID NO: 7227 - RNA, 19 nt, artificial
  Chemically synthesized
uagagagguggcuuaggcu

SEQ ID NO: 7228 - RNA, 19 nt, artificial
  Chemically synthesized
guuagaagaagaaaacgcc

SEQ ID NO: 7229 - RNA, 19 nt, artificial
  Chemically synthesized
uauucaaacucagcacagg

SEQ ID NO: 7230 - RNA, 19 nt, artificial
  Chemically synthesized
aaguguuggacccagcugg

SEQ ID NO: 7231 - RNA, 19 nt, artificial
  Chemically synthesized
uuccauucaaaagacucag

SEQ ID NO: 7232 - RNA, 19 nt, artificial
  Chemically synthesized
ucugugucucccuaaagag

SEQ ID NO: 7233 - RNA, 19 nt, artificial
  Chemically synthesized
agauacuacaagcacacug

SEQ ID NO: 7234 - RNA, 19 nt, artificial
  Chemically synthesized
uuugucaaacuuuuccaag

SEQ ID NO: 7235 - RNA, 19 nt, artificial
  Chemically synthesized
uuuccucauuucucccuuc

SEQ ID NO: 7236 - RNA, 19 nt, artificial
  Chemically synthesized
uugagaacagcaaccuuug

SEQ ID NO: 7237 - RNA, 19 nt, artificial
  Chemically synthesized
aaugucaagguaaaugagg

SEQ ID NO: 7238 - RNA, 19 nt, artificial
  Chemically synthesized
aauaauaucaucgagguag

SEQ ID NO: 7239 - RNA, 19 nt, artificial
  Chemically synthesized
aaacucacucauuuguuuc

SEQ ID NO: 7240 - RNA, 19 nt, artificial
  Chemically synthesized
uucacaaguacaagcaaag

SEQ ID NO: 7241 - RNA, 19 nt, artificial
  Chemically synthesized
uuaggaauuagccacuaga

SEQ ID NO: 7242 - RNA, 19 nt, artificial
  Chemically synthesized
uaggaauuagccacuagac

SEQ ID NO: 7243 - RNA, 19 nt, artificial
  Chemically synthesized
ucggaauucuucaaugguc

SEQ ID NO: 7244 - RNA, 19 nt, artificial
  Chemically synthesized
uucagggacaggucuaaag

SEQ ID NO: 7245 - RNA, 19 nt, artificial
  Chemically synthesized
aaacacacucugaaacacu

SEQ ID NO: 7246 - RNA, 19 nt, artificial
  Chemically synthesized
aauugucuggauuucacac

SEQ ID NO: 7247 - RNA, 19 nt, artificial
  Chemically synthesized
uucucuagagaugcuagau

SEQ ID NO: 7248 - RNA, 19 nt, artificial
  Chemically synthesized
auauguuucuggaaucaag

SEQ ID NO: 7249 - RNA, 19 nt, artificial
  Chemically synthesized
ucaaugauaacauccacuc

SEQ ID NO: 7250 - RNA, 19 nt, artificial
  Chemically synthesized
uauuuccucauuucucccu

SEQ ID NO: 7251 - RNA, 19 nt, artificial
  Chemically synthesized
agaguagagaacucaucuc

SEQ ID NO: 7252 - RNA, 19 nt, artificial
  Chemically synthesized
uuuugagauguccaauggg

SEQ ID NO: 7253 - RNA, 19 nt, artificial
  Chemically synthesized
uagucuaaguaugcuaauc

SEQ ID NO: 7254 - RNA, 19 nt, artificial
  Chemically synthesized
gagacuguaaucaagaacc

SEQ ID NO: 7255 - RNA, 19 nt, artificial
  Chemically synthesized
uugguugaaaugcccaccu

SEQ ID NO: 7256 - RNA, 19 nt, artificial
  Chemically synthesized
aaaaauaaacuucugcugc

SEQ ID NO: 7257 - RNA, 19 nt, artificial
  Chemically synthesized
uucacacguaguucuccug

SEQ ID NO: 7258 - RNA, 19 nt, artificial
  Chemically synthesized
cuuucaaauacacacagcc

SEQ ID NO: 7259 - RNA, 19 nt, artificial
  Chemically synthesized
aauauuaagguagagaggu

SEQ ID NO: 7260 - RNA, 19 nt, artificial
  Chemically synthesized
uuuaagaaagcuagacuac

SEQ ID NO: 7261 - RNA, 19 nt, artificial
  Chemically synthesized
uucaagacuucgagacugg

SEQ ID NO: 7262 - RNA, 19 nt, artificial
  Chemically synthesized
uuguccaugauaagaccag

SEQ ID NO: 7263 - RNA, 19 nt, artificial
  Chemically synthesized
ugaauguucuguuucugag

SEQ ID NO: 7264 - RNA, 19 nt, artificial
  Chemically synthesized
uuagcauucuggacuuuug

SEQ ID NO: 7265 - RNA, 19 nt, artificial
  Chemically synthesized
uagaagaagaaaacgccug

SEQ ID NO: 7266 - RNA, 19 nt, artificial
  Chemically synthesized
uuagccacuagacuuuaac

SEQ ID NO: 7267 - RNA, 19 nt, artificial
  Chemically synthesized
uuuccuuaggaauuagcca

SEQ ID NO: 7268 - RNA, 19 nt, artificial
  Chemically synthesized
agaacucaucucaaacagc

SEQ ID NO: 7269 - RNA, 19 nt, artificial
  Chemically synthesized
cauuugauguagaacccgc

SEQ ID NO: 7270 - RNA, 19 nt, artificial
  Chemically synthesized
uuugaagcacgucuuaaac

SEQ ID NO: 7271 - RNA, 19 nt, artificial
  Chemically synthesized
ugagacauggaaacacacc

SEQ ID NO: 7272 - RNA, 19 nt, artificial
  Chemically synthesized
uucuguaaacuugauaguc

SEQ ID NO: 7273 - RNA, 19 nt, artificial
  Chemically synthesized
aauggauguauucuucaag

SEQ ID NO: 7274 - RNA, 19 nt, artificial
  Chemically synthesized
aacucaagccauuucuacu

SEQ ID NO: 7275 - RNA, 19 nt, artificial
  Chemically synthesized
uagaacccgcaagucugug

SEQ ID NO: 7276 - RNA, 19 nt, artificial
  Chemically synthesized
ucucuuucuguuuucucug

SEQ ID NO: 7277 - RNA, 19 nt, artificial
  Chemically synthesized
aauugguguauucaaagca

SEQ ID NO: 7278 - RNA, 19 nt, artificial
  Chemically synthesized
cacuggugucuucucuucc

SEQ ID NO: 7279 - RNA, 19 nt, artificial
  Chemically synthesized
uguaguuccuguuuuuugg

SEQ ID NO: 7280 - RNA, 19 nt, artificial
  Chemically synthesized
accaauuagacaacucccu

SEQ ID NO: 7281 - RNA, 19 nt, artificial
  Chemically synthesized
uucuugaauguucuguuuc

SEQ ID NO: 7282 - RNA, 19 nt, artificial
  Chemically synthesized
uuugucacaggagaggaag

SEQ ID NO: 7283 - RNA, 19 nt, artificial
  Chemically synthesized
ugauguagaacccgcaagu

SEQ ID NO: 7284 - RNA, 19 nt, artificial
  Chemically synthesized
acuagcucauuccuuaccc

SEQ ID NO: 7285 - RNA, 19 nt, artificial
  Chemically synthesized
uuucaugacagucauuacu

SEQ ID NO: 7286 - RNA, 19 nt, artificial
  Chemically synthesized
uucaaauacacacagcccu

SEQ ID NO: 7287 - RNA, 19 nt, artificial
  Chemically synthesized
aaggaaaaagugaacaccc

SEQ ID NO: 7288 - RNA, 19 nt, artificial
  Chemically synthesized
uuucaagacuucgagacug

SEQ ID NO: 7289 - RNA, 19 nt, artificial
  Chemically synthesized
ucucccuuccuccuuuucc

SEQ ID NO: 7290 - RNA, 19 nt, artificial
  Chemically synthesized
ugauaguccagaaaaggcu

SEQ ID NO: 7291 - RNA, 19 nt, artificial
  Chemically synthesized
ucacaggagaggaaguuag

SEQ ID NO: 7292 - RNA, 19 nt, artificial
  Chemically synthesized
ucucaaacagccauagaca

SEQ ID NO: 7293 - RNA, 19 nt, artificial
  Chemically synthesized
uucuggacuuuuguuucuc

SEQ ID NO: 7294 - RNA, 19 nt, artificial
  Chemically synthesized
aacacuucugacugugguc

SEQ ID NO: 7295 - RNA, 19 nt, artificial
  Chemically synthesized
ucuuucuguuuucucuguc

SEQ ID NO: 7296 - RNA, 19 nt, artificial
  Chemically synthesized
uucugugagcagcaguggc

SEQ ID NO: 7297 - RNA, 19 nt, artificial
  Chemically synthesized
ucaaauggauguauucuuc

SEQ ID NO: 7298 - RNA, 19 nt, artificial
  Chemically synthesized
ugagcauguguuaaucagg

SEQ ID NO: 7299 - RNA, 19 nt, artificial
  Chemically synthesized
auagucacacucaccaggg

SEQ ID NO: 7300 - RNA, 19 nt, artificial
  Chemically synthesized
uuucuguuuucucugucuu

SEQ ID NO: 7301 - RNA, 19 nt, artificial
  Chemically synthesized
uucucaaugauaacaucca

SEQ ID NO: 7302 - RNA, 19 nt, artificial
  Chemically synthesized
auugcaggaaacucuggug

SEQ ID NO: 7303 - RNA, 19 nt, artificial
  Chemically synthesized
uucuggucucacgcaggag

SEQ ID NO: 7304 - RNA, 19 nt, artificial
  Chemically synthesized
uaucugaagguguugcaca

SEQ ID NO: 7305 - RNA, 19 nt, artificial
  Chemically synthesized
uuuaguaccugaagacugg

SEQ ID NO: 7306 - RNA, 19 nt, artificial
  Chemically synthesized
aaagucagcuuaugaagcc

SEQ ID NO: 7307 - RNA, 19 nt, artificial
  Chemically synthesized
uuccugucaauauuaaggu

SEQ ID NO: 7308 - RNA, 19 nt, artificial
  Chemically synthesized
agucuaaguaugcuaaucg

SEQ ID NO: 7309 - RNA, 19 nt, artificial
  Chemically synthesized
uuaacugaacaaguguugg

SEQ ID NO: 7310 - RNA, 19 nt, artificial
  Chemically synthesized
aaugucucuuucuguuuuc

SEQ ID NO: 7311 - RNA, 19 nt, artificial
  Chemically synthesized
guuuccuuaggaauuagcc

SEQ ID NO: 7312 - RNA, 19 nt, artificial
  Chemically synthesized
accuucuuuauaagaaccc

SEQ ID NO: 7313 - RNA, 19 nt, artificial
  Chemically synthesized
aguucucuagagaugcuag

SEQ ID NO: 7314 - RNA, 19 nt, artificial
  Chemically synthesized
aaagacucaggaaaagaac

SEQ ID NO: 7315 - RNA, 19 nt, artificial
  Chemically synthesized
uguucuaagcccaagaagu

SEQ ID NO: 7316 - RNA, 19 nt, artificial
  Chemically synthesized
uaagguagagagguggcuu

SEQ ID NO: 7317 - RNA, 19 nt, artificial
  Chemically synthesized
aaaggaaaaagugaacacc

SEQ ID NO: 7318 - RNA, 19 nt, artificial
  Chemically synthesized
uccuugacugaguugguug

SEQ ID NO: 7319 - RNA, 19 nt, artificial
  Chemically synthesized
cuucauuucuaaauucucc

SEQ ID NO: 7320 - RNA, 19 nt, artificial
  Chemically synthesized
uuagaagaagaaaacgccu

SEQ ID NO: 7321 - RNA, 19 nt, artificial
  Chemically synthesized
agauuugucaaacuuuucc

SEQ ID NO: 7322 - RNA, 19 nt, artificial
  Chemically synthesized
acugagaucuagaaacuca

SEQ ID NO: 7323 - RNA, 19 nt, artificial
  Chemically synthesized
aaauagaacaugcucgaga

SEQ ID NO: 7324 - RNA, 19 nt, artificial
  Chemically synthesized
aagacuucgagacuggaca

SEQ ID NO: 7325 - RNA, 19 nt, artificial
  Chemically synthesized
aaucacuuugagaacagca

SEQ ID NO: 7326 - RNA, 19 nt, artificial
  Chemically synthesized
aauugcauccuguacccac

SEQ ID NO: 7327 - RNA, 19 nt, artificial
  Chemically synthesized
uucaacuuccaccaagagc

SEQ ID NO: 7328 - RNA, 19 nt, artificial
  Chemically synthesized
caaacagccauagacaucc

SEQ ID NO: 7329 - RNA, 19 nt, artificial
  Chemically synthesized
uuucaaugugggaaacugu

SEQ ID NO: 7330 - RNA, 19 nt, artificial
  Chemically synthesized
ugauuuaccauccagcagg

SEQ ID NO: 7331 - RNA, 19 nt, artificial
  Chemically synthesized
agaacuuauagaccagaac

SEQ ID NO: 7332 - RNA, 19 nt, artificial
  Chemically synthesized
auccuguacccacuguucc

SEQ ID NO: 7333 - RNA, 19 nt, artificial
  Chemically synthesized
aaagauacaccagcggcuc

SEQ ID NO: 7334 - RNA, 19 nt, artificial
  Chemically synthesized
aauacugaaaacucacuca

SEQ ID NO: 7335 - RNA, 19 nt, artificial
  Chemically synthesized
aagaaagcuagacuacuug

SEQ ID NO: 7336 - RNA, 19 nt, artificial
  Chemically synthesized
uugaacucaugguaauaac

SEQ ID NO: 7337 - RNA, 19 nt, artificial
  Chemically synthesized
uuaucagcccauauguuuc

SEQ ID NO: 7338 - RNA, 19 nt, artificial
  Chemically synthesized
agacucuguauuuuagucu

SEQ ID NO: 7339 - RNA, 19 nt, artificial
  Chemically synthesized
uuacuuaguaggcaauaac

SEQ ID NO: 7340 - RNA, 19 nt, artificial
  Chemically synthesized
uuucugaggcacugguguc

SEQ ID NO: 7341 - RNA, 19 nt, artificial
  Chemically synthesized
aagcccaagaaguuugaac

SEQ ID NO: 7342 - RNA, 19 nt, artificial
  Chemically synthesized
auuccaugauuuaccaucc

SEQ ID NO: 7343 - RNA, 19 nt, artificial
  Chemically synthesized
ucaauagucacacucacca

SEQ ID NO: 7344 - RNA, 19 nt, artificial
  Chemically synthesized
ucuucagauagauguugcu

SEQ ID NO: 7345 - RNA, 19 nt, artificial
  Chemically synthesized
acagcaaccuuugaaacuc

SEQ ID NO: 7346 - RNA, 19 nt, artificial
  Chemically synthesized
aacucaugguaauaacacc

SEQ ID NO: 7347 - RNA, 19 nt, artificial
  Chemically synthesized
gucuucuccaccuucugca

SEQ ID NO: 7348 - RNA, 19 nt, artificial
  Chemically synthesized
ucuucuccaccuucugcag

SEQ ID NO: 7349 - RNA, 19 nt, artificial
  Chemically synthesized
ugucucccuaaagagauuc

SEQ ID NO: 7350 - RNA, 19 nt, artificial
  Chemically synthesized
aagucucuguagugaaggc

SEQ ID NO: 7351 - RNA, 19 nt, artificial
  Chemically synthesized
gaaacagcaauguauacuc

SEQ ID NO: 7352 - RNA, 19 nt, artificial
  Chemically synthesized
acugaguugguugaaaugc

SEQ ID NO: 7353 - RNA, 19 nt, artificial
  Chemically synthesized
acaaugaagaugauaccag

SEQ ID NO: 7354 - RNA, 19 nt, artificial
  Chemically synthesized
uucacuaguacaugagaca

SEQ ID NO: 7355 - RNA, 19 nt, artificial
  Chemically synthesized
uuagcagcccugcauaucu

SEQ ID NO: 7356 - RNA, 19 nt, artificial
  Chemically synthesized
caagaguagagaacucauc

SEQ ID NO: 7357 - RNA, 19 nt, artificial
  Chemically synthesized
aaucacacucucuucuaua

SEQ ID NO: 7358 - RNA, 19 nt, artificial
  Chemically synthesized
aaagugaacacccaguuca

SEQ ID NO: 7359 - RNA, 19 nt, artificial
  Chemically synthesized
acucccugccuugaauacc

SEQ ID NO: 7360 - RNA, 19 nt, artificial
  Chemically synthesized
accauggaauuacucaccc

SEQ ID NO: 7361 - RNA, 19 nt, artificial
  Chemically synthesized
uccauugcaggaaacucug

SEQ ID NO: 7362 - RNA, 19 nt, artificial
  Chemically synthesized
auguucuaguuguucuaag

SEQ ID NO: 7363 - RNA, 19 nt, artificial
  Chemically synthesized
uuucuacugagaucuagaa

SEQ ID NO: 7364 - RNA, 19 nt, artificial
  Chemically synthesized
uucuacugagaucuagaaa

SEQ ID NO: 7365 - RNA, 19 nt, artificial
  Chemically synthesized
aagaaguuugaacucaugg

SEQ ID NO: 7366 - RNA, 19 nt, artificial
  Chemically synthesized
caucauagauguuuucacc

SEQ ID NO: 7367 - RNA, 19 nt, artificial
  Chemically synthesized
aaacucugguguucacaag

SEQ ID NO: 7368 - RNA, 19 nt, artificial
  Chemically synthesized
uggaauuacucacccuuag

SEQ ID NO: 7369 - RNA, 19 nt, artificial
  Chemically synthesized
agaaugaccaggaugguug

SEQ ID NO: 7370 - RNA, 19 nt, artificial
  Chemically synthesized
ugcuagauuugucuccaca

SEQ ID NO: 7371 - RNA, 19 nt, artificial
  Chemically synthesized
ucucugucuuuauucaacu

SEQ ID NO: 7372 - RNA, 19 nt, artificial
  Chemically synthesized
uugaaagcaacucuggugu

SEQ ID NO: 7373 - RNA, 19 nt, artificial
  Chemically synthesized
ugccauugaaagcaacucu

SEQ ID NO: 7374 - RNA, 19 nt, artificial
  Chemically synthesized
aaacucagcacaggcaugc

SEQ ID NO: 7375 - RNA, 19 nt, artificial
  Chemically synthesized
uucaacuugaugagguaag

SEQ ID NO: 7376 - RNA, 19 nt, artificial
  Chemically synthesized
acaggugauauucaaacuc

SEQ ID NO: 7377 - RNA, 19 nt, artificial
  Chemically synthesized
uaagaaagcuagacuacuu

SEQ ID NO: 7378 - RNA, 19 nt, artificial
  Chemically synthesized
uugucuggauuucacaccu

SEQ ID NO: 7379 - RNA, 19 nt, artificial
  Chemically synthesized
uagcucauuccuuacccag

SEQ ID NO: 7380 - RNA, 19 nt, artificial
  Chemically synthesized
uguuggaagugaaaguaag

SEQ ID NO: 7381 - RNA, 19 nt, artificial
  Chemically synthesized
gaaacugccaggucugagc

SEQ ID NO: 7382 - RNA, 19 nt, artificial
  Chemically synthesized
agagauuugaguuucaaug

SEQ ID NO: 7383 - RNA, 19 nt, artificial
  Chemically synthesized
acuuccuugaaaaauagug

SEQ ID NO: 7384 - RNA, 19 nt, artificial
  Chemically synthesized
acuuccaccaagagcugcc

SEQ ID NO: 7385 - RNA, 19 nt, artificial
  Chemically synthesized
aguucugggcuaaagggug

SEQ ID NO: 7386 - RNA, 19 nt, artificial
  Chemically synthesized
aaugcugcuuucaugacag

SEQ ID NO: 7387 - RNA, 19 nt, artificial
  Chemically synthesized
uagaccagaacugcuacaa

SEQ ID NO: 7388 - RNA, 19 nt, artificial
  Chemically synthesized
aaacacuucugacuguggu

SEQ ID NO: 7389 - RNA, 19 nt, artificial
  Chemically synthesized
uggagagugaguuaaaugc

SEQ ID NO: 7390 - RNA, 19 nt, artificial
  Chemically synthesized
aguucagacacuuauaagg

SEQ ID NO: 7391 - RNA, 19 nt, artificial
  Chemically synthesized
acucaagccauuucuacug

SEQ ID NO: 7392 - RNA, 19 nt, artificial
  Chemically synthesized
uggaagugaaaguaagccu

SEQ ID NO: 7393 - RNA, 19 nt, artificial
  Chemically synthesized
aggacaaugaagaugauac

SEQ ID NO: 7394 - RNA, 19 nt, artificial
  Chemically synthesized
auggucuuauucaucugac

SEQ ID NO: 7395 - RNA, 19 nt, artificial
  Chemically synthesized
aacugaacaaguguuggac

SEQ ID NO: 7396 - RNA, 19 nt, artificial
  Chemically synthesized
ugacaacugaauuuuguug

SEQ ID NO: 7397 - RNA, 19 nt, artificial
  Chemically synthesized
uucaaagcaguucugggcu

SEQ ID NO: 7398 - RNA, 19 nt, artificial
  Chemically synthesized
aaagcaacucuggugugag

SEQ ID NO: 7399 - RNA, 19 nt, artificial
  Chemically synthesized
uugucuccacagccaccag

SEQ ID NO: 7400 - RNA, 19 nt, artificial
  Chemically synthesized
ugaccgagcaguuucugag

SEQ ID NO: 7401 - RNA, 19 nt, artificial
  Chemically synthesized
gagacauggaaacacaccc

SEQ ID NO: 7402 - RNA, 19 nt, artificial
  Chemically synthesized
ucauauuuccaguuuugac

SEQ ID NO: 7403 - RNA, 19 nt, artificial
  Chemically synthesized
uauguuucuggaaucaaga

SEQ ID NO: 7404 - RNA, 19 nt, artificial
  Chemically synthesized
uucuaaauucucccagaac

SEQ ID NO: 7405 - RNA, 19 nt, artificial
  Chemically synthesized
uuuaccauccagcagggcu

SEQ ID NO: 7406 - RNA, 19 nt, artificial
  Chemically synthesized
aucucuuuugucacaggag

SEQ ID NO: 7407 - RNA, 19 nt, artificial
  Chemically synthesized
aucaggugaaaauagaacu

SEQ ID NO: 7408 - RNA, 19 nt, artificial
  Chemically synthesized
cucauuucucccuuccucc

SEQ ID NO: 7409 - RNA, 19 nt, artificial
  Chemically synthesized
uuuguuggaagugaaagua

SEQ ID NO: 7410 - RNA, 19 nt, artificial
  Chemically synthesized
ucucccuaaagagauucag

SEQ ID NO: 7411 - RNA, 19 nt, artificial
  Chemically synthesized
acuucgagacuggacaagc

SEQ ID NO: 7412 - RNA, 19 nt, artificial
  Chemically synthesized
gaauacugaaaacucacuc

SEQ ID NO: 7413 - RNA, 19 nt, artificial
  Chemically synthesized
uucaauggucaaauugcac

SEQ ID NO: 7414 - RNA, 19 nt, artificial
  Chemically synthesized
uucaauugucuggauuuca

SEQ ID NO: 7415 - RNA, 19 nt, artificial
  Chemically synthesized
auucguucaacuuccacca

SEQ ID NO: 7416 - RNA, 19 nt, artificial
  Chemically synthesized
ugagguaagaguugaaaug

SEQ ID NO: 7417 - RNA, 19 nt, artificial
  Chemically synthesized
auauuaagguagagaggug

SEQ ID NO: 7418 - RNA, 19 nt, artificial
  Chemically synthesized
uucugaggcacuggugucu

SEQ ID NO: 7419 - RNA, 19 nt, artificial
  Chemically synthesized
ugcguggcucgcuaucacc

SEQ ID NO: 7420 - RNA, 19 nt, artificial
  Chemically synthesized
uuucacaccuccacgcagg

SEQ ID NO: 7421 - RNA, 19 nt, artificial
  Chemically synthesized
ucccuaaagagauucagag

SEQ ID NO: 7422 - RNA, 19 nt, artificial
  Chemically synthesized
uaaucacacucucuucuau

SEQ ID NO: 7423 - RNA, 19 nt, artificial
  Chemically synthesized
aacaaaggcaucauagaug

SEQ ID NO: 7424 - RNA, 19 nt, artificial
  Chemically synthesized
augcuagauuugucuccac

SEQ ID NO: 7425 - RNA, 19 nt, artificial
  Chemically synthesized
uacagauaugaucaugcgg

SEQ ID NO: 7426 - RNA, 19 nt, artificial
  Chemically synthesized
uuuccaguuuugacaacug

SEQ ID NO: 7427 - RNA, 19 nt, artificial
  Chemically synthesized
auaaagucucuguagugaa

SEQ ID NO: 7428 - RNA, 19 nt, artificial
  Chemically synthesized
uaucucuuuugucacagga

SEQ ID NO: 7429 - RNA, 19 nt, artificial
  Chemically synthesized
uugugagccacauuaaguu

SEQ ID NO: 7430 - RNA, 19 nt, artificial
  Chemically synthesized
aagaacaaugucucuuucu

SEQ ID NO: 7431 - RNA, 19 nt, artificial
  Chemically synthesized
ucaucucaaacagccauag

SEQ ID NO: 7432 - RNA, 19 nt, artificial
  Chemically synthesized
uacaagcacaagaguagag

SEQ ID NO: 7433 - RNA, 19 nt, artificial
  Chemically synthesized
caaauuauuucaaugcugc

SEQ ID NO: 7434 - RNA, 19 nt, artificial
  Chemically synthesized
uucaccucuaccauacuuu

SEQ ID NO: 7435 - RNA, 19 nt, artificial
  Chemically synthesized
uaguccagaaaaggcuccc

SEQ ID NO: 7436 - RNA, 19 nt, artificial
  Chemically synthesized
auugugagccacauuaagu

SEQ ID NO: 7437 - RNA, 19 nt, artificial
  Chemically synthesized
uuacccaguccucauccug

SEQ ID NO: 7438 - RNA, 19 nt, artificial
  Chemically synthesized
uuacucacccuuagcauaa

SEQ ID NO: 7439 - RNA, 19 nt, artificial
  Chemically synthesized
auauucaaagauacaccag

SEQ ID NO: 7440 - RNA, 19 nt, artificial
  Chemically synthesized
auaucaucgagguaguagu

SEQ ID NO: 7441 - RNA, 19 nt, artificial
  Chemically synthesized
auuaagguagagagguggc

SEQ ID NO: 7442 - RNA, 19 nt, artificial
  Chemically synthesized
aaaguucauaggguucagg

SEQ ID NO: 7443 - RNA, 19 nt, artificial
  Chemically synthesized
auuacucacccuuagcaua

SEQ ID NO: 7444 - RNA, 19 nt, artificial
  Chemically synthesized
cuuauaaggaaacguaucc

SEQ ID NO: 7445 - RNA, 19 nt, artificial
  Chemically synthesized
uagaaacucaaggcuuggu

SEQ ID NO: 7446 - RNA, 19 nt, artificial
  Chemically synthesized
acacauuguuuucucaaug

SEQ ID NO: 7447 - RNA, 19 nt, artificial
  Chemically synthesized
auagaccagaacugcuaca

SEQ ID NO: 7448 - RNA, 19 nt, artificial
  Chemically synthesized
auauuuaguaccugaagac

SEQ ID NO: 7449 - RNA, 19 nt, artificial
  Chemically synthesized
aaguucucuagagaugcua

SEQ ID NO: 7450 - RNA, 19 nt, artificial
  Chemically synthesized
uaugaucaugcggacacac

SEQ ID NO: 7451 - RNA, 19 nt, artificial
  Chemically synthesized
auugagacuguaaucaaga

SEQ ID NO: 7452 - RNA, 19 nt, artificial
  Chemically synthesized
ugaucaugcggacacacac

SEQ ID NO: 7453 - RNA, 19 nt, artificial
  Chemically synthesized
augacuuucuuugucaugg

SEQ ID NO: 7454 - RNA, 19 nt, artificial
  Chemically synthesized
acagucauuacuuaguagg

SEQ ID NO: 7455 - RNA, 19 nt, artificial
  Chemically synthesized
augauggucuuauucaucu

SEQ ID NO: 7456 - RNA, 19 nt, artificial
  Chemically synthesized
guugguugaaaugcccacc

SEQ ID NO: 7457 - RNA, 19 nt, artificial
  Chemically synthesized
auuucuuuaaaugcaccug

SEQ ID NO: 7458 - RNA, 19 nt, artificial
  Chemically synthesized
acaccgggaauaaagucuc

SEQ ID NO: 7459 - RNA, 19 nt, artificial
  Chemically synthesized
ugugaguaugagaaauguc

SEQ ID NO: 7460 - RNA, 19 nt, artificial
  Chemically synthesized
auucuuuacuagcucauuc

SEQ ID NO: 7461 - RNA, 19 nt, artificial
  Chemically synthesized
gagaucuagaaacucaagg

SEQ ID NO: 7462 - RNA, 19 nt, artificial
  Chemically synthesized
uuucugagucgucuccaga

SEQ ID NO: 7463 - RNA, 19 nt, artificial
  Chemically synthesized
aaggucaaguuucucagcu

SEQ ID NO: 7464 - RNA, 19 nt, artificial
  Chemically synthesized
ugaggcacuggugucuucu

SEQ ID NO: 7465 - RNA, 19 nt, artificial
  Chemically synthesized
uaggaauacugaaaacuca

SEQ ID NO: 7466 - RNA, 19 nt, artificial
  Chemically synthesized
uaguaccugaagacuggag

SEQ ID NO: 7467 - RNA, 19 nt, artificial
  Chemically synthesized
uaaaccagccagaccuuga

SEQ ID NO: 7468 - RNA, 19 nt, artificial
  Chemically synthesized
uacucacccuuagcauaag

SEQ ID NO: 7469 - RNA, 19 nt, artificial
  Chemically synthesized
uccuuuucuugaauguucu

SEQ ID NO: 7470 - RNA, 19 nt, artificial
  Chemically synthesized
augaacauucuuuucuggg

SEQ ID NO: 7471 - RNA, 19 nt, artificial
  Chemically synthesized
ugaaaugcccaccuggaag

SEQ ID NO: 7472 - RNA, 19 nt, artificial
  Chemically synthesized
aguaugagaaaugucaagg

SEQ ID NO: 7473 - RNA, 19 nt, artificial
  Chemically synthesized
uuaugugauugagacugua

SEQ ID NO: 7474 - RNA, 19 nt, artificial
  Chemically synthesized
ucacuuugagaacagcaac

SEQ ID NO: 7475 - RNA, 19 nt, artificial
  Chemically synthesized
cugaguugguugaaaugcc

SEQ ID NO: 7476 - RNA, 19 nt, artificial
  Chemically synthesized
uggugucuucucuuccucg

SEQ ID NO: 7477 - RNA, 19 nt, artificial
  Chemically synthesized
ugacagaguguacuuuucc

SEQ ID NO: 7478 - RNA, 19 nt, artificial
  Chemically synthesized
uuuccucuucagauagaug

SEQ ID NO: 7479 - RNA, 19 nt, artificial
  Chemically synthesized
cuagauuugucuccacagc

SEQ ID NO: 7480 - RNA, 19 nt, artificial
  Chemically synthesized
cauuaugugauugagacug

SEQ ID NO: 7481 - RNA, 19 nt, artificial
  Chemically synthesized
auaaucacacucucuucua

SEQ ID NO: 7482 - RNA, 19 nt, artificial
  Chemically synthesized
ucacacucucuucuauaca

SEQ ID NO: 7483 - RNA, 19 nt, artificial
  Chemically synthesized
acucacccuuagcauaagg

SEQ ID NO: 7484 - RNA, 19 nt, artificial
  Chemically synthesized
ucauggaugauguuggcag

SEQ ID NO: 7485 - RNA, 19 nt, artificial
  Chemically synthesized
auacacacagcccugauag

SEQ ID NO: 7486 - RNA, 19 nt, artificial
  Chemically synthesized
augccauugaaagcaacuc

SEQ ID NO: 7487 - RNA, 19 nt, artificial
  Chemically synthesized
aauagaacuuauagaccag

SEQ ID NO: 7488 - RNA, 19 nt, artificial
  Chemically synthesized
aacugcuacaacagauacu

SEQ ID NO: 7489 - RNA, 19 nt, artificial
  Chemically synthesized
auauucaaacucagcacag

SEQ ID NO: 7490 - RNA, 19 nt, artificial
  Chemically synthesized
cugagugauaggaauacug

SEQ ID NO: 7491 - RNA, 19 nt, artificial
  Chemically synthesized
ucgagaaugaccaggaugg

SEQ ID NO: 7492 - RNA, 19 nt, artificial
  Chemically synthesized
aacaugcucgagaaugacc

SEQ ID NO: 7493 - RNA, 19 nt, artificial
  Chemically synthesized
ucaaaccaaacacacucug

SEQ ID NO: 7494 - RNA, 19 nt, artificial
  Chemically synthesized
aacacacucugaaacacuc

SEQ ID NO: 7495 - RNA, 19 nt, artificial
  Chemically synthesized
ugccugagcagggucuucu

SEQ ID NO: 7496 - RNA, 19 nt, artificial
  Chemically synthesized
uucugaaaaagcauuccca

SEQ ID NO: 7497 - RNA, 19 nt, artificial
  Chemically synthesized
ucauuucaugaggucaccc

SEQ ID NO: 7498 - RNA, 19 nt, artificial
  Chemically synthesized
ugucuucucuuccucgagc

SEQ ID NO: 7499 - RNA, 19 nt, artificial
  Chemically synthesized
ugacugaguugguugaaau

SEQ ID NO: 7500 - RNA, 19 nt, artificial
  Chemically synthesized
uuucucagcucugugaaga

SEQ ID NO: 7501 - RNA, 19 nt, artificial
  Chemically synthesized
ucauagauguuuucaccuc

SEQ ID NO: 7502 - RNA, 19 nt, artificial
  Chemically synthesized
uucggcuuuuauggaaacc

SEQ ID NO: 7503 - RNA, 19 nt, artificial
  Chemically synthesized
agaaacugccaggucugag

SEQ ID NO: 7504 - RNA, 19 nt, artificial
  Chemically synthesized
agaacaaugucucuuucug

SEQ ID NO: 7505 - RNA, 19 nt, artificial
  Chemically synthesized
aauaacaccauugaagcuc

SEQ ID NO: 7506 - RNA, 19 nt, artificial
  Chemically synthesized
aggaaaagaacaaugucuc

SEQ ID NO: 7507 - RNA, 19 nt, artificial
  Chemically synthesized
aucuagaaacucaaggcuu

SEQ ID NO: 7508 - RNA, 19 nt, artificial
  Chemically synthesized
uggaugaacauucuuuucu

SEQ ID NO: 7509 - RNA, 19 nt, artificial
  Chemically synthesized
ucuaguuguucuaagccca

SEQ ID NO: 7510 - RNA, 19 nt, artificial
  Chemically synthesized
auggucaaauugcacaggc

SEQ ID NO: 7511 - RNA, 19 nt, artificial
  Chemically synthesized
ugauggucuuauucaucug

SEQ ID NO: 7512 - RNA, 19 nt, artificial
  Chemically synthesized
augacaucgagugacaaag

SEQ ID NO: 7513 - RNA, 19 nt, artificial
  Chemically synthesized
ucagcccauauguuucugg

SEQ ID NO: 7514 - RNA, 19 nt, artificial
  Chemically synthesized
aaugguuuuaugauggcua

SEQ ID NO: 7515 - RNA, 19 nt, artificial
  Chemically synthesized
uucuggaaucaagaaaagg

SEQ ID NO: 7516 - RNA, 19 nt, artificial
  Chemically synthesized
uuuucaagacuucgagacu

SEQ ID NO: 7517 - RNA, 19 nt, artificial
  Chemically synthesized
aucacacucucuucuauac

SEQ ID NO: 7518 - RNA, 19 nt, artificial
  Chemically synthesized
ucaaacuuuuccaaguuuc

SEQ ID NO: 7519 - RNA, 19 nt, artificial
  Chemically synthesized
ugugucucccuaaagagau

SEQ ID NO: 7520 - RNA, 19 nt, artificial
  Chemically synthesized
uuuacuagcucauuccuua

SEQ ID NO: 7521 - RNA, 19 nt, artificial
  Chemically synthesized
uucuccaccuucugcagga

SEQ ID NO: 7522 - RNA, 19 nt, artificial
  Chemically synthesized
agauuuaagaaagcuagac

SEQ ID NO: 7523 - RNA, 19 nt, artificial
  Chemically synthesized
uucgagacuggacaagcca

SEQ ID NO: 7524 - RNA, 19 nt, artificial
  Chemically synthesized
acacucaguaacaaacacu

SEQ ID NO: 7525 - RNA, 19 nt, artificial
  Chemically synthesized
aaaugucaagguaaaugag

SEQ ID NO: 7526 - RNA, 19 nt, artificial
  Chemically synthesized
aagcacaagaguagagaac

SEQ ID NO: 7527 - RNA, 19 nt, artificial
  Chemically synthesized
cucacccuuagcauaaggc

SEQ ID NO: 7528 - RNA, 19 nt, artificial
  Chemically synthesized
auguucaaucacccuagac

SEQ ID NO: 7529 - RNA, 19 nt, artificial
  Chemically synthesized
uuauagcuucauucagaca

SEQ ID NO: 7530 - RNA, 19 nt, artificial
  Chemically synthesized
auucccucugcacuggaag

SEQ ID NO: 7531 - RNA, 19 nt, artificial
  Chemically synthesized
uguggcucauauuuaguac

SEQ ID NO: 7532 - RNA, 19 nt, artificial
  Chemically synthesized
uguauucaaagcaguucug

SEQ ID NO: 7533 - RNA, 19 nt, artificial
  Chemically synthesized
ugagaucuagaaacucaag

SEQ ID NO: 7534 - RNA, 19 nt, artificial
  Chemically synthesized
auaaacuucugcugcaacu

SEQ ID NO: 7535 - RNA, 19 nt, artificial
  Chemically synthesized
auugguguauucaaagcag

SEQ ID NO: 7536 - RNA, 19 nt, artificial
  Chemically synthesized
uucccaccuuuguuggaag

SEQ ID NO: 7537 - RNA, 19 nt, artificial
  Chemically synthesized
auguauacucccugccuug

SEQ ID NO: 7538 - RNA, 19 nt, artificial
  Chemically synthesized
uuauggaaaccuucaugga

SEQ ID NO: 7539 - RNA, 19 nt, artificial
  Chemically synthesized
aaaucacuuugagaacagc

SEQ ID NO: 7540 - RNA, 19 nt, artificial
  Chemically synthesized
ugcucuagauuggucagau

SEQ ID NO: 7541 - RNA, 19 nt, artificial
  Chemically synthesized
ugagguuucugagugauag

SEQ ID NO: 7542 - RNA, 19 nt, artificial
  Chemically synthesized
gauuugucuccacagccac

SEQ ID NO: 7543 - RNA, 19 nt, artificial
  Chemically synthesized
augugauugagacuguaau

SEQ ID NO: 7544 - RNA, 19 nt, artificial
  Chemically synthesized
ugcuaaucggaauucuuca

SEQ ID NO: 7545 - RNA, 19 nt, artificial
  Chemically synthesized
uggaaaaugcuguaguucc

SEQ ID NO: 7546 - RNA, 19 nt, artificial
  Chemically synthesized
ucuaagcccaagaaguuug

SEQ ID NO: 7547 - RNA, 19 nt, artificial
  Chemically synthesized
ugagcagggucuucuccac

SEQ ID NO: 7548 - RNA, 19 nt, artificial
  Chemically synthesized
ucggcuuuuauggaaaccu

SEQ ID NO: 7549 - RNA, 19 nt, artificial
  Chemically synthesized
ugauauuagcuuauaggca

SEQ ID NO: 7550 - RNA, 19 nt, artificial
  Chemically synthesized
uguacaagcacaagaguag

SEQ ID NO: 7551 - RNA, 19 nt, artificial
  Chemically synthesized
guuuucucugucuuuauuc

SEQ ID NO: 7552 - RNA, 19 nt, artificial
  Chemically synthesized
auggcugggaucagagucc

SEQ ID NO: 7553 - RNA, 19 nt, artificial
  Chemically synthesized
uuggagacaacugcuccag

SEQ ID NO: 7554 - RNA, 19 nt, artificial
  Chemically synthesized
auauggauauuugaagcac

SEQ ID NO: 7555 - RNA, 19 nt, artificial
  Chemically synthesized
ucauuccuuacccaguccu

SEQ ID NO: 7556 - RNA, 19 nt, artificial
  Chemically synthesized
uaggguucagggacagguc

SEQ ID NO: 7557 - RNA, 19 nt, artificial
  Chemically synthesized
aacuucugcugcaacucau

SEQ ID NO: 7558 - RNA, 19 nt, artificial
  Chemically synthesized
uugcaggaaacucuggugu

SEQ ID NO: 7559 - RNA, 19 nt, artificial
  Chemically synthesized
acaaacacuucugacugug

SEQ ID NO: 7560 - RNA, 19 nt, artificial
  Chemically synthesized
aguggcuaaagaaacagca

SEQ ID NO: 7561 - RNA, 19 nt, artificial
  Chemically synthesized
gaaauauaaucacacucuc

SEQ ID NO: 7562 - RNA, 19 nt, artificial
  Chemically synthesized
ugagugauaggaauacuga

SEQ ID NO: 7563 - RNA, 19 nt, artificial
  Chemically synthesized
ucaguaacaaacacuucug

SEQ ID NO: 7564 - RNA, 19 nt, artificial
  Chemically synthesized
aacucaucucaaacagcca

SEQ ID NO: 7565 - RNA, 19 nt, artificial
  Chemically synthesized
aagaguugaaaugacuuuc

SEQ ID NO: 7566 - RNA, 19 nt, artificial
  Chemically synthesized
uguucuguuucugaggagg

SEQ ID NO: 7567 - RNA, 19 nt, artificial
  Chemically synthesized
ucaccuuucggcuuuuaug

SEQ ID NO: 7568 - RNA, 19 nt, artificial
  Chemically synthesized
ucuuuuacccuuucaauag

SEQ ID NO: 7569 - RNA, 19 nt, artificial
  Chemically synthesized
uucugagugauaggaauac

SEQ ID NO: 7570 - RNA, 19 nt, artificial
  Chemically synthesized
aacuugaugagguaagagu

SEQ ID NO: 7571 - RNA, 19 nt, artificial
  Chemically synthesized
uucaugacagucauuacuu

SEQ ID NO: 7572 - RNA, 19 nt, artificial
  Chemically synthesized
ugccauccgaaauuauaag

SEQ ID NO: 7573 - RNA, 19 nt, artificial
  Chemically synthesized
ugcaccauggaauuacuca

SEQ ID NO: 7574 - RNA, 19 nt, artificial
  Chemically synthesized
cuugaguagauaacaaagg

SEQ ID NO: 7575 - RNA, 19 nt, artificial
  Chemically synthesized
aauaccuucacacguaguu

SEQ ID NO: 7576 - RNA, 19 nt, artificial
  Chemically synthesized
cuauuuccucauuucuccc

SEQ ID NO: 7577 - RNA, 19 nt, artificial
  Chemically synthesized
guagagagguggcuuaggc

SEQ ID NO: 7578 - RNA, 19 nt, artificial
  Chemically synthesized
auuccuuacccaguccuca

SEQ ID NO: 7579 - RNA, 19 nt, artificial
  Chemically synthesized
acuuugagaacagcaaccu

SEQ ID NO: 7580 - RNA, 19 nt, artificial
  Chemically synthesized
agcuccuugagauuagcag

SEQ ID NO: 7581 - RNA, 19 nt, artificial
  Chemically synthesized
ugacuuucuuugucauggg

SEQ ID NO: 7582 - RNA, 19 nt, artificial
  Chemically synthesized
uagauuggucagauuagaa

SEQ ID NO: 7583 - RNA, 19 nt, artificial
  Chemically synthesized
ucgagugacaaagugacag

SEQ ID NO: 7584 - RNA, 19 nt, artificial
  Chemically synthesized
ugaagaugccauugaaagc

SEQ ID NO: 7585 - RNA, 19 nt, artificial
  Chemically synthesized
auuaacugaacaaguguug

SEQ ID NO: 7586 - RNA, 19 nt, artificial
  Chemically synthesized
auuguccuuuucuugaaug

SEQ ID NO: 7587 - RNA, 19 nt, artificial
  Chemically synthesized
uagccacuagacuuuaacc

SEQ ID NO: 7588 - RNA, 19 nt, artificial
  Chemically synthesized
agaaaugucaagguaaaug

SEQ ID NO: 7589 - RNA, 19 nt, artificial
  Chemically synthesized
ucagaaacugccaggucug

SEQ ID NO: 7590 - RNA, 19 nt, artificial
  Chemically synthesized
gaagcggaaauuuucuucc

SEQ ID NO: 7591 - RNA, 19 nt, artificial
  Chemically synthesized
ucuguuucugaggaggcug

SEQ ID NO: 7592 - RNA, 19 nt, artificial
  Chemically synthesized
auugccagccauuuucaag

SEQ ID NO: 7593 - RNA, 19 nt, artificial
  Chemically synthesized
ccuauuuccucauuucucc

SEQ ID NO: 7594 - RNA, 19 nt, artificial
  Chemically synthesized
aaucacccuagaccugcuc

SEQ ID NO: 7595 - RNA, 19 nt, artificial
  Chemically synthesized
aucaugcggacacacacac

SEQ ID NO: 7596 - RNA, 19 nt, artificial
  Chemically synthesized
uacccacuguuccuucugg

SEQ ID NO: 7597 - RNA, 19 nt, artificial
  Chemically synthesized
aacaaguguuggacccagc

SEQ ID NO: 7598 - RNA, 19 nt, artificial
  Chemically synthesized
uacccuuucaauagucaca

SEQ ID NO: 7599 - RNA, 19 nt, artificial
  Chemically synthesized
gaauaaagucucuguagug

SEQ ID NO: 7600 - RNA, 19 nt, artificial
  Chemically synthesized
aauaaagucucuguaguga

SEQ ID NO: 7601 - RNA, 19 nt, artificial
  Chemically synthesized
gucuucucuuccucgagcc

SEQ ID NO: 7602 - RNA, 19 nt, artificial
  Chemically synthesized
uugagauuagcagcccugc

SEQ ID NO: 7603 - RNA, 19 nt, artificial
  Chemically synthesized
uauacucccugccuugaau

SEQ ID NO: 7604 - RNA, 19 nt, artificial
  Chemically synthesized
auuuauucccucugcacug

SEQ ID NO: 7605 - RNA, 19 nt, artificial
  Chemically synthesized
aaugcuggaaauccagaug

SEQ ID NO: 7606 - RNA, 19 nt, artificial
  Chemically synthesized
uuucugggaaccuucuuua

SEQ ID NO: 7607 - RNA, 19 nt, artificial
  Chemically synthesized
auacagauaugaucaugcg

SEQ ID NO: 7608 - RNA, 19 nt, artificial
  Chemically synthesized
acacugaggaccgacacac

SEQ ID NO: 7609 - RNA, 19 nt, artificial
  Chemically synthesized
aagcggaaauuuucuuccc

SEQ ID NO: 7610 - RNA, 19 nt, artificial
  Chemically synthesized
uccuugagauuagcagccc

SEQ ID NO: 7611 - RNA, 19 nt, artificial
  Chemically synthesized
aucauagauguuuucaccu

SEQ ID NO: 7612 - RNA, 19 nt, artificial
  Chemically synthesized
auacugaaaacucacucau

SEQ ID NO: 7613 - RNA, 19 nt, artificial
  Chemically synthesized
aaaugguuuuaugauggcu

SEQ ID NO: 7614 - RNA, 19 nt, artificial
  Chemically synthesized
cuuauagaccagaacugcu

SEQ ID NO: 7615 - RNA, 19 nt, artificial
  Chemically synthesized
uugaauaccuucacacgua

SEQ ID NO: 7616 - RNA, 19 nt, artificial
  Chemically synthesized
uugugagcauguguuaauc

SEQ ID NO: 7617 - RNA, 19 nt, artificial
  Chemically synthesized
gauuggauaagauugugag

SEQ ID NO: 7618 - RNA, 19 nt, artificial
  Chemically synthesized
ucaagccauuucuacugag

SEQ ID NO: 7619 - RNA, 19 nt, artificial
  Chemically synthesized
uaaagggugagaggaagug

SEQ ID NO: 7620 - RNA, 19 nt, artificial
  Chemically synthesized
aaagaacaaugucucuuuc

SEQ ID NO: 7621 - RNA, 19 nt, artificial
  Chemically synthesized
agauguuuucaccucuacc

SEQ ID NO: 7622 - RNA, 19 nt, artificial
  Chemically synthesized
uuuggaagucauuauguga

SEQ ID NO: 7623 - RNA, 19 nt, artificial
  Chemically synthesized
uucaaucacccuagaccug

SEQ ID NO: 7624 - RNA, 19 nt, artificial
  Chemically synthesized
uucaaugcugcuuucauga

SEQ ID NO: 7625 - RNA, 19 nt, artificial
  Chemically synthesized
ucuuauucaucugacaggu

SEQ ID NO: 7626 - RNA, 19 nt, artificial
  Chemically synthesized
gauagauguugcuuccugc

SEQ ID NO: 7627 - RNA, 19 nt, artificial
  Chemically synthesized
aacgccugcagaccagugg

SEQ ID NO: 7628 - RNA, 19 nt, artificial
  Chemically synthesized
uguccaugauaagaccagg

SEQ ID NO: 7629 - RNA, 19 nt, artificial
  Chemically synthesized
auaacauccacucuuccca

SEQ ID NO: 7630 - RNA, 19 nt, artificial
  Chemically synthesized
aaugcacacaucuacuuuc

SEQ ID NO: 7631 - RNA, 19 nt, artificial
  Chemically synthesized
caugauaagaccaggaagc

SEQ ID NO: 7632 - RNA, 19 nt, artificial
  Chemically synthesized
caccauggaauuacucacc

SEQ ID NO: 7633 - RNA, 19 nt, artificial
  Chemically synthesized
uuuccauucaaaagacuca

SEQ ID NO: 7634 - RNA, 19 nt, artificial
  Chemically synthesized
acuuucacuaguacaugag

SEQ ID NO: 7635 - RNA, 19 nt, artificial
  Chemically synthesized
gaaagauuggauaagauug

SEQ ID NO: 7636 - RNA, 19 nt, artificial
  Chemically synthesized
aaagagagauugaguaggg

SEQ ID NO: 7637 - RNA, 19 nt, artificial
  Chemically synthesized
ucaaacagccauagacauc

SEQ ID NO: 7638 - RNA, 19 nt, artificial
  Chemically synthesized
acuaguacaugagacaugg

SEQ ID NO: 7639 - RNA, 19 nt, artificial
  Chemically synthesized
ucacacguaguucuccugg

SEQ ID NO: 7640 - RNA, 19 nt, artificial
  Chemically synthesized
uggcuaaagaaacagcaag

SEQ ID NO: 7641 - RNA, 19 nt, artificial
  Chemically synthesized
agcaguucugggcuaaagg

SEQ ID NO: 7642 - RNA, 19 nt, artificial
  Chemically synthesized
auuugaguuucaauguggg

SEQ ID NO: 7643 - RNA, 19 nt, artificial
  Chemically synthesized
aggaauacugaaaacucac

SEQ ID NO: 7644 - RNA, 19 nt, artificial
  Chemically synthesized
ugguagaucaacuucugaa

SEQ ID NO: 7645 - RNA, 19 nt, artificial
  Chemically synthesized
uuuuccucuucagauagau

SEQ ID NO: 7646 - RNA, 19 nt, artificial
  Chemically synthesized
aauaucaucgagguaguag

SEQ ID NO: 7647 - RNA, 19 nt, artificial
  Chemically synthesized
agaaagcuagacuacuugg

SEQ ID NO: 7648 - RNA, 19 nt, artificial
  Chemically synthesized
uucuguuuucucugucuuu

SEQ ID NO: 7649 - RNA, 19 nt, artificial
  Chemically synthesized
ggaaguucucuagagaugc

SEQ ID NO: 7650 - RNA, 19 nt, artificial
  Chemically synthesized
aauggucaaauugcacagg

SEQ ID NO: 7651 - RNA, 19 nt, artificial
  Chemically synthesized
aguugguugaaaugcccac

SEQ ID NO: 7652 - RNA, 19 nt, artificial
  Chemically synthesized
ugauguuggcagcaauggc

SEQ ID NO: 7653 - RNA, 19 nt, artificial
  Chemically synthesized
uaagccuuuugagagauuu

SEQ ID NO: 7654 - RNA, 19 nt, artificial
  Chemically synthesized
uugaagcacgucuuaaaca

SEQ ID NO: 7655 - RNA, 19 nt, artificial
  Chemically synthesized
gauuagaaaaauacucagg

SEQ ID NO: 7656 - RNA, 19 nt, artificial
  Chemically synthesized
aaacucaaggcuugguaga

SEQ ID NO: 7657 - RNA, 19 nt, artificial
  Chemically synthesized
ucaauggucaaauugcaca

SEQ ID NO: 7658 - RNA, 19 nt, artificial
  Chemically synthesized
agggucuucuccaccuucu

SEQ ID NO: 7659 - RNA, 19 nt, artificial
  Chemically synthesized
uugauaguccagaaaaggc

SEQ ID NO: 7660 - RNA, 19 nt, artificial
  Chemically synthesized
acuuuuccaaguuuccuuc

SEQ ID NO: 7661 - RNA, 19 nt, artificial
  Chemically synthesized
uuaccauccagcagggcuu

SEQ ID NO: 7662 - RNA, 19 nt, artificial
  Chemically synthesized
caggagaggaaguuagaag

SEQ ID NO: 7663 - RNA, 19 nt, artificial
  Chemically synthesized
auaggguucagggacaggu

SEQ ID NO: 7664 - RNA, 19 nt, artificial
  Chemically synthesized
aucaaacaucacuuguucu

SEQ ID NO: 7665 - RNA, 19 nt, artificial
  Chemically synthesized
aacagcaaccuuugaaacu

SEQ ID NO: 7666 - RNA, 19 nt, artificial
  Chemically synthesized
cgucuccagaagaugugcc

SEQ ID NO: 7667 - RNA, 19 nt, artificial
  Chemically synthesized
uugguguauucaaagcagu

SEQ ID NO: 7668 - RNA, 19 nt, artificial
  Chemically synthesized
gcaucuugcaucaggagcc

SEQ ID NO: 7669 - RNA, 19 nt, artificial
  Chemically synthesized
acuucuaaaccagccagac

SEQ ID NO: 7670 - RNA, 19 nt, artificial
  Chemically synthesized
auuuccucauuucucccuu

SEQ ID NO: 7671 - RNA, 19 nt, artificial
  Chemically synthesized
uugcacaggcccucuagag

SEQ ID NO: 7672 - RNA, 19 nt, artificial
  Chemically synthesized
agaaacucaaggcuuggua

SEQ ID NO: 7673 - RNA, 19 nt, artificial
  Chemically synthesized
ugcaggacaaugaagauga

SEQ ID NO: 7674 - RNA, 19 nt, artificial
  Chemically synthesized
cacuuugagaacagcaacc

SEQ ID NO: 7675 - RNA, 19 nt, artificial
  Chemically synthesized
aaacuucugcugcaacuca

SEQ ID NO: 7676 - RNA, 19 nt, artificial
  Chemically synthesized
ugauaagaccaggaagcgg

SEQ ID NO: 7677 - RNA, 19 nt, artificial
  Chemically synthesized
ugaagaugauaccagcacg

SEQ ID NO: 7678 - RNA, 19 nt, artificial
  Chemically synthesized
acaugcucgagaaugacca

SEQ ID NO: 7679 - RNA, 19 nt, artificial
  Chemically synthesized
guucuuucaaaguuuugag

SEQ ID NO: 7680 - RNA, 19 nt, artificial
  Chemically synthesized
aaagcggcaaccuuagcau

SEQ ID NO: 7681 - RNA, 19 nt, artificial
  Chemically synthesized
uaguucuccuggcagugag

SEQ ID NO: 7682 - RNA, 19 nt, artificial
  Chemically synthesized
uuaaccucuguaaggagac

SEQ ID NO: 7683 - RNA, 19 nt, artificial
  Chemically synthesized
agucucuguagugaaggca

SEQ ID NO: 7684 - RNA, 19 nt, artificial
  Chemically synthesized
uucccucugcacuggaagc

SEQ ID NO: 7685 - RNA, 19 nt, artificial
  Chemically synthesized
acucaaggcuugguagauc

SEQ ID NO: 7686 - RNA, 19 nt, artificial
  Chemically synthesized
aaaaggaaaaagugaacac

SEQ ID NO: 7687 - RNA, 19 nt, artificial
  Chemically synthesized
uugucauggguuccuugac

SEQ ID NO: 7688 - RNA, 19 nt, artificial
  Chemically synthesized
aaacugccaggucugagca

SEQ ID NO: 7689 - RNA, 19 nt, artificial
  Chemically synthesized
cucuucagauagauguugc

SEQ ID NO: 7690 - RNA, 19 nt, artificial
  Chemically synthesized
aagacucuguauuuuaguc

SEQ ID NO: 7691 - RNA, 19 nt, artificial
  Chemically synthesized
cuucuauacagauaugauc

SEQ ID NO: 7692 - RNA, 19 nt, artificial
  Chemically synthesized
uuggaagucauuaugugau

SEQ ID NO: 7693 - RNA, 19 nt, artificial
  Chemically synthesized
ucaaggagcauugcccaac

SEQ ID NO: 7694 - RNA, 19 nt, artificial
  Chemically synthesized
acugaacaaguguuggacc

SEQ ID NO: 7695 - RNA, 19 nt, artificial
  Chemically synthesized
aaggcucccagggcuaaac

SEQ ID NO: 7696 - RNA, 19 nt, artificial
  Chemically synthesized
ucauuucuaaauucuccca

SEQ ID NO: 7697 - RNA, 19 nt, artificial
  Chemically synthesized
ugauaacauccacucuucc

SEQ ID NO: 7698 - RNA, 19 nt, artificial
  Chemically synthesized
uuuauucaacuugaugagg

SEQ ID NO: 7699 - RNA, 19 nt, artificial
  Chemically synthesized
cauuucuaaauucucccag

SEQ ID NO: 7700 - RNA, 19 nt, artificial
  Chemically synthesized
uacuuuuccauacuuccuu

SEQ ID NO: 7701 - RNA, 19 nt, artificial
  Chemically synthesized
cuuguugcuggaaaggucc

SEQ ID NO: 7702 - RNA, 19 nt, artificial
  Chemically synthesized
agaucuaaauacuuuaggc

SEQ ID NO: 7703 - RNA, 19 nt, artificial
  Chemically synthesized
uaugugauugagacuguaa

SEQ ID NO: 7704 - RNA, 19 nt, artificial
  Chemically synthesized
aacaaugucucuuucuguu

SEQ ID NO: 7705 - RNA, 19 nt, artificial
  Chemically synthesized
auuguccaugauaagacca

SEQ ID NO: 7706 - RNA, 19 nt, artificial
  Chemically synthesized
ugaaaugacuuucuuuguc

SEQ ID NO: 7707 - RNA, 19 nt, artificial
  Chemically synthesized
uugaauguucuguuucuga

SEQ ID NO: 7708 - RNA, 19 nt, artificial
  Chemically synthesized
acuguggucauauuuccag

SEQ ID NO: 7709 - RNA, 19 nt, artificial
  Chemically synthesized
uguacccacuguuccuucu

SEQ ID NO: 7710 - RNA, 19 nt, artificial
  Chemically synthesized
acucaggaaaagaacaaug

SEQ ID NO: 7711 - RNA, 19 nt, artificial
  Chemically synthesized
auuuccaguuuugacaacu

SEQ ID NO: 7712 - RNA, 19 nt, artificial
  Chemically synthesized
cuuucuggucucacgcagg

SEQ ID NO: 7713 - RNA, 19 nt, artificial
  Chemically synthesized
cucuagagcagauuuguca

SEQ ID NO: 7714 - RNA, 19 nt, artificial
  Chemically synthesized
uuuucuucccguuuaaaag

SEQ ID NO: 7715 - RNA, 19 nt, artificial
  Chemically synthesized
gucucuuucuguuuucucu

SEQ ID NO: 7716 - RNA, 19 nt, artificial
  Chemically synthesized
augcuguuggagacaacug

SEQ ID NO: 7717 - RNA, 19 nt, artificial
  Chemically synthesized
acccuuucaauagucacac

SEQ ID NO: 7718 - RNA, 19 nt, artificial
  Chemically synthesized
ucuccuggcagugagaagg

SEQ ID NO: 7719 - RNA, 19 nt, artificial
  Chemically synthesized
acucagcacaggcaugccc

SEQ ID NO: 7720 - RNA, 19 nt, artificial
  Chemically synthesized
auuagcagcccugcauauc

SEQ ID NO: 7721 - RNA, 19 nt, artificial
  Chemically synthesized
aaugcuguuggagacaacu

SEQ ID NO: 7722 - RNA, 19 nt, artificial
  Chemically synthesized
auacauagggauaugugca

SEQ ID NO: 7723 - RNA, 19 nt, artificial
  Chemically synthesized
ucuuuugucacaggagagg

SEQ ID NO: 7724 - RNA, 19 nt, artificial
  Chemically synthesized
uuggaaugcuggaaaucca

SEQ ID NO: 7725 - RNA, 19 nt, artificial
  Chemically synthesized
uacucccugccuugaauac

SEQ ID NO: 7726 - RNA, 19 nt, artificial
  Chemically synthesized
cuucauucagacauaauug

SEQ ID NO: 7727 - RNA, 19 nt, artificial
  Chemically synthesized
uucugggcuaaagggugag

SEQ ID NO: 7728 - RNA, 19 nt, artificial
  Chemically synthesized
aaauucucccagaaccaaa

SEQ ID NO: 7729 - RNA, 19 nt, artificial
  Chemically synthesized
uggucaaauugcacaggcc

SEQ ID NO: 7730 - RNA, 19 nt, artificial
  Chemically synthesized
auaguccagaaaaggcucc

SEQ ID NO: 7731 - RNA, 19 nt, artificial
  Chemically synthesized
aauaaacuucugcugcaac

SEQ ID NO: 7732 - RNA, 19 nt, artificial
  Chemically synthesized
uauggaaaccuucauggau

SEQ ID NO: 7733 - RNA, 19 nt, artificial
  Chemically synthesized
uuccuggaaagaauugcca

SEQ ID NO: 7734 - RNA, 19 nt, artificial
  Chemically synthesized
aaccucuguaaggagacag

SEQ ID NO: 7735 - RNA, 19 nt, artificial
  Chemically synthesized
auuggauaagauugugagc

SEQ ID NO: 7736 - RNA, 19 nt, artificial
  Chemically synthesized
cgacugcucagaaacugcc

SEQ ID NO: 7737 - RNA, 19 nt, artificial
  Chemically synthesized
auuccauucguucaacuuc

SEQ ID NO: 7738 - RNA, 19 nt, artificial
  Chemically synthesized
guucaaucacccuagaccu

SEQ ID NO: 7739 - RNA, 19 nt, artificial
  Chemically synthesized
agugaaaguaagccuuuug

SEQ ID NO: 7740 - RNA, 19 nt, artificial
  Chemically synthesized
auaucuggaaggaaguuuu

SEQ ID NO: 7741 - RNA, 19 nt, artificial
  Chemically synthesized
ugagaggaagugaaagcgg

SEQ ID NO: 7742 - RNA, 19 nt, artificial
  Chemically synthesized
acagauacuacaagcacac

SEQ ID NO: 7743 - RNA, 19 nt, artificial
  Chemically synthesized
ucauuucucccuuccuccu

SEQ ID NO: 7744 - RNA, 19 nt, artificial
  Chemically synthesized
agcauucccaccuuuguug

SEQ ID NO: 7745 - RNA, 19 nt, artificial
  Chemically synthesized
gaaaccuucauggaugaug

SEQ ID NO: 7746 - RNA, 19 nt, artificial
  Chemically synthesized
agcaaucucauauucaaag

SEQ ID NO: 7747 - RNA, 19 nt, artificial
  Chemically synthesized
uguuccuucuggauuccau

SEQ ID NO: 7748 - RNA, 19 nt, artificial
  Chemically synthesized
aaauccagauguucuaguu

SEQ ID NO: 7749 - RNA, 19 nt, artificial
  Chemically synthesized
aauguauacucccugccuu

SEQ ID NO: 7750 - RNA, 19 nt, artificial
  Chemically synthesized
aaaagcauucccaccuuug

SEQ ID NO: 7751 - RNA, 19 nt, artificial
  Chemically synthesized
aacugcuccaguugacacu

SEQ ID NO: 7752 - RNA, 19 nt, artificial
  Chemically synthesized
acuggugucuucucuuccu

SEQ ID NO: 7753 - RNA, 19 nt, artificial
  Chemically synthesized
accaaugauggucuuauuc

SEQ ID NO: 7754 - RNA, 19 nt, artificial
  Chemically synthesized
uccaagugcucuagauugg

SEQ ID NO: 7755 - RNA, 19 nt, artificial
  Chemically synthesized
augucucuuucuguuuucu

SEQ ID NO: 7756 - RNA, 19 nt, artificial
  Chemically synthesized
ucugagucgucuccagaag

SEQ ID NO: 7757 - RNA, 19 nt, artificial
  Chemically synthesized
auugcauccuguacccacu

SEQ ID NO: 7758 - RNA, 19 nt, artificial
  Chemically synthesized
ucuuuucugggaaccuucu

SEQ ID NO: 7759 - RNA, 19 nt, artificial
  Chemically synthesized
acgucuuaaacaaccuuau

SEQ ID NO: 7760 - RNA, 19 nt, artificial
  Chemically synthesized
uucaucugacaggugauau

SEQ ID NO: 7761 - RNA, 19 nt, artificial
  Chemically synthesized
cuuccuugaaaaauagugg

SEQ ID NO: 7762 - RNA, 19 nt, artificial
  Chemically synthesized
uguugcuuccugccaauug

SEQ ID NO: 7763 - RNA, 19 nt, artificial
  Chemically synthesized
ucgucuccagaagaugugc

SEQ ID NO: 7764 - RNA, 19 nt, artificial
  Chemically synthesized
auuucuaaauucucccaga

SEQ ID NO: 7765 - RNA, 19 nt, artificial
  Chemically synthesized
acuacaagcacacugagga

SEQ ID NO: 7766 - RNA, 19 nt, artificial
  Chemically synthesized
uucuuugucauggguuccu

SEQ ID NO: 7767 - RNA, 19 nt, artificial
  Chemically synthesized
uguuguggcucauauuuag

SEQ ID NO: 7768 - RNA, 19 nt, artificial
  Chemically synthesized
ugagagagguccaggaagg

SEQ ID NO: 7769 - RNA, 19 nt, artificial
  Chemically synthesized
ugugagccacauuaaguuc

SEQ ID NO: 7770 - RNA, 19 nt, artificial
  Chemically synthesized
uuugaaacucaagccauuu

SEQ ID NO: 7771 - RNA, 19 nt, artificial
  Chemically synthesized
aggcacuggugucuucucu

SEQ ID NO: 7772 - RNA, 19 nt, artificial
  Chemically synthesized
gaugcuagauuugucucca

SEQ ID NO: 7773 - RNA, 19 nt, artificial
  Chemically synthesized
agguaguagucuaaguaug

SEQ ID NO: 7774 - RNA, 19 nt, artificial
  Chemically synthesized
uaaguaugcuaaucggaau

SEQ ID NO: 7775 - RNA, 19 nt, artificial
  Chemically synthesized
auuaugugauugagacugu

SEQ ID NO: 7776 - RNA, 19 nt, artificial
  Chemically synthesized
ugguccuugauccauugca

SEQ ID NO: 7777 - RNA, 19 nt, artificial
  Chemically synthesized
ugaauaccuucacacguag

SEQ ID NO: 7778 - RNA, 19 nt, artificial
  Chemically synthesized
uucuguuucugaggaggcu

SEQ ID NO: 7779 - RNA, 19 nt, artificial
  Chemically synthesized
agguccaucaaacaucacu

SEQ ID NO: 7780 - RNA, 19 nt, artificial
  Chemically synthesized
uagauguuuucaccucuac

SEQ ID NO: 7781 - RNA, 19 nt, artificial
  Chemically synthesized
accuucacacguaguucuc

SEQ ID NO: 7782 - RNA, 19 nt, artificial
  Chemically synthesized
uccuuccugccucuagccc

SEQ ID NO: 7783 - RNA, 19 nt, artificial
  Chemically synthesized
aacgauggacuucuaaacc

SEQ ID NO: 7784 - RNA, 19 nt, artificial
  Chemically synthesized
auaaggaaacguauccaau

SEQ ID NO: 7785 - RNA, 19 nt, artificial
  Chemically synthesized
accuuugaaacucaagcca

SEQ ID NO: 7786 - RNA, 19 nt, artificial
  Chemically synthesized
agccacauuaaguucuuuc

SEQ ID NO: 7787 - RNA, 19 nt, artificial
  Chemically synthesized
aacuuuuccaaguuuccuu

SEQ ID NO: 7788 - RNA, 19 nt, artificial
  Chemically synthesized
uucuuuaaaugcaccuggu

SEQ ID NO: 7789 - RNA, 19 nt, artificial
  Chemically synthesized
uggucuuauucaucugaca

SEQ ID NO: 7790 - RNA, 19 nt, artificial
  Chemically synthesized
aacuucugaaaaagcauuc

SEQ ID NO: 7791 - RNA, 19 nt, artificial
  Chemically synthesized
gaauuacucacccuuagca

SEQ ID NO: 7792 - RNA, 19 nt, artificial
  Chemically synthesized
ugcugcaacucauuucaug

SEQ ID NO: 7793 - RNA, 19 nt, artificial
  Chemically synthesized
augaagaugauaccagcac

SEQ ID NO: 7794 - RNA, 19 nt, artificial
  Chemically synthesized
aaacacucaguaacaaaca

SEQ ID NO: 7795 - RNA, 19 nt, artificial
  Chemically synthesized
agauuugucuccacagcca

SEQ ID NO: 7796 - RNA, 19 nt, artificial
  Chemically synthesized
aaaaauagaacaugcucga

SEQ ID NO: 7797 - RNA, 19 nt, artificial
  Chemically synthesized
cagcuuucuggucucacgc

SEQ ID NO: 7798 - RNA, 19 nt, artificial
  Chemically synthesized
agggcucccagcuuucugg

SEQ ID NO: 7799 - RNA, 19 nt, artificial
  Chemically synthesized
aaaaucacuuugagaacag

SEQ ID NO: 7800 - RNA, 19 nt, artificial
  Chemically synthesized
ugucaauauuaagguagag

SEQ ID NO: 7801 - RNA, 19 nt, artificial
  Chemically synthesized
caauauuaagguagagagg

SEQ ID NO: 7802 - RNA, 19 nt, artificial
  Chemically synthesized
gaaacucaaggcuugguag

SEQ ID NO: 7803 - RNA, 19 nt, artificial
  Chemically synthesized
cuucacacguaguucuccu

SEQ ID NO: 7804 - RNA, 19 nt, artificial
  Chemically synthesized
aguaacaaacacuucugac

SEQ ID NO: 7805 - RNA, 19 nt, artificial
  Chemically synthesized
agggcuaaacucuggaugg

SEQ ID NO: 7806 - RNA, 19 nt, artificial
  Chemically synthesized
aaauguugccauccgaaau

SEQ ID NO: 7807 - RNA, 19 nt, artificial
  Chemically synthesized
gaguagagaacucaucuca

SEQ ID NO: 7808 - RNA, 19 nt, artificial
  Chemically synthesized
aagcucagaucuaaauacu

SEQ ID NO: 7809 - RNA, 19 nt, artificial
  Chemically synthesized
auguggucaaggagcauug

SEQ ID NO: 7810 - RNA, 19 nt, artificial
  Chemically synthesized
uagauguugcuuccugcca

SEQ ID NO: 7811 - RNA, 19 nt, artificial
  Chemically synthesized
uacaccagcggcucuggau

SEQ ID NO: 7812 - RNA, 19 nt, artificial
  Chemically synthesized
ucauccucacugcuucugu

SEQ ID NO: 7813 - RNA, 19 nt, artificial
  Chemically synthesized
uaguuguucuaagcccaag

SEQ ID NO: 7814 - RNA, 19 nt, artificial
  Chemically synthesized
uuguggcucauauuuagua

SEQ ID NO: 7815 - RNA, 19 nt, artificial
  Chemically synthesized
agaaguuugaacucauggu

SEQ ID NO: 7816 - RNA, 19 nt, artificial
  Chemically synthesized
aacucugguguucacaagu

SEQ ID NO: 7817 - RNA, 19 nt, artificial
  Chemically synthesized
aagccuuuugagagauuug

SEQ ID NO: 7818 - RNA, 19 nt, artificial
  Chemically synthesized
ucugcugcaacucauuuca

SEQ ID NO: 7819 - RNA, 19 nt, artificial
  Chemically synthesized
uccauucaaaagacucagg

SEQ ID NO: 7820 - RNA, 19 nt, artificial
  Chemically synthesized
uagcuuauaggcaagacgu

SEQ ID NO: 7821 - RNA, 19 nt, artificial
  Chemically synthesized
gcaauguauacucccugcc

SEQ ID NO: 7822 - RNA, 19 nt, artificial
  Chemically synthesized
uccaggaaggucaaguuuc

SEQ ID NO: 7823 - RNA, 19 nt, artificial
  Chemically synthesized
uuccuuacccaguccucau

SEQ ID NO: 7824 - RNA, 19 nt, artificial
  Chemically synthesized
uuuauucccucugcacugg

SEQ ID NO: 7825 - RNA, 19 nt, artificial
  Chemically synthesized
aucuagugcaccauggaau

SEQ ID NO: 7826 - RNA, 19 nt, artificial
  Chemically synthesized
aagucauuaugugauugag

SEQ ID NO: 7827 - RNA, 19 nt, artificial
  Chemically synthesized
acacacagcccugauaggg

SEQ ID NO: 7828 - RNA, 19 nt, artificial
  Chemically synthesized
gcuugguagaucaacuucu

SEQ ID NO: 7829 - RNA, 19 nt, artificial
  Chemically synthesized
uuccuugaaaaauaguggu

SEQ ID NO: 7830 - RNA, 19 nt, artificial
  Chemically synthesized
uacauagggauaugugcac

SEQ ID NO: 7831 - RNA, 19 nt, artificial
  Chemically synthesized
uguuccugcugagaaggcg

SEQ ID NO: 7832 - RNA, 19 nt, artificial
  Chemically synthesized
ucuccaccuucugcaggac

SEQ ID NO: 7833 - RNA, 19 nt, artificial
  Chemically synthesized
uugucccaaaaucacuuug

SEQ ID NO: 7834 - RNA, 19 nt, artificial
  Chemically synthesized
uaaucagguuuccuuagga

SEQ ID NO: 7835 - RNA, 19 nt, artificial
  Chemically synthesized
cuggauuccaugauuuacc

SEQ ID NO: 7836 - RNA, 19 nt, artificial
  Chemically synthesized
acugcuacaacagauacua

SEQ ID NO: 7837 - RNA, 19 nt, artificial
  Chemically synthesized
acaugagacauggaaacac

SEQ ID NO: 7838 - RNA, 19 nt, artificial
  Chemically synthesized
aauuccagacacauuguuu

SEQ ID NO: 7839 - RNA, 19 nt, artificial
  Chemically synthesized
uucucagcucugugaagau

SEQ ID NO: 7840 - RNA, 19 nt, artificial
  Chemically synthesized
uuuacccuuucaauaguca

SEQ ID NO: 7841 - RNA, 19 nt, artificial
  Chemically synthesized
ucucuagagaugcuagauu

SEQ ID NO: 7842 - RNA, 19 nt, artificial
  Chemically synthesized
uucucccuuccuccuuuuc

SEQ ID NO: 7843 - RNA, 19 nt, artificial
  Chemically synthesized
uagcauucuggacuuuugu

SEQ ID NO: 7844 - RNA, 19 nt, artificial
  Chemically synthesized
cuuucuguuuucucugucu

SEQ ID NO: 7845 - RNA, 19 nt, artificial
  Chemically synthesized
aacacacccagggauguuc

SEQ ID NO: 7846 - RNA, 19 nt, artificial
  Chemically synthesized
ugaccaggaugguugugag

SEQ ID NO: 7847 - RNA, 19 nt, artificial
  Chemically synthesized
aagcaguucugggcuaaag

SEQ ID NO: 7848 - RNA, 19 nt, artificial
  Chemically synthesized
acuucugaaaaagcauucc

SEQ ID NO: 7849 - RNA, 19 nt, artificial
  Chemically synthesized
agagauucagagguccauc

SEQ ID NO: 7850 - RNA, 19 nt, artificial
  Chemically synthesized
gaucuagaaacucaaggcu

SEQ ID NO: 7851 - RNA, 19 nt, artificial
  Chemically synthesized
uuggaaaaugcuguaguuc

SEQ ID NO: 7852 - RNA, 19 nt, artificial
  Chemically synthesized
uaaauguugccauccgaaa

SEQ ID NO: 7853 - RNA, 19 nt, artificial
  Chemically synthesized
uugcauccuguacccacug

SEQ ID NO: 7854 - RNA, 19 nt, artificial
  Chemically synthesized
guaaucaagaaccuggagg

SEQ ID NO: 7855 - RNA, 19 nt, artificial
  Chemically synthesized
uuaauuccagacacauugu

SEQ ID NO: 7856 - RNA, 19 nt, artificial
  Chemically synthesized
aaggcgguacagcuccacc

SEQ ID NO: 7857 - RNA, 19 nt, artificial
  Chemically synthesized
ccuucauuucuaaauucuc

SEQ ID NO: 7858 - RNA, 19 nt, artificial
  Chemically synthesized
gggcauuugauguagaacc

SEQ ID NO: 7859 - RNA, 19 nt, artificial
  Chemically synthesized
cuucugaaaaagcauuccc

SEQ ID NO: 7860 - RNA, 19 nt, artificial
  Chemically synthesized
aucuaaauacuuuaggcug

SEQ ID NO: 7861 - RNA, 19 nt, artificial
  Chemically synthesized
aacucagcacaggcaugcc

SEQ ID NO: 7862 - RNA, 19 nt, artificial
  Chemically synthesized
uaugugcacaaaugcacac

SEQ ID NO: 7863 - RNA, 19 nt, artificial
  Chemically synthesized
accacaacaaucaccuuuc

SEQ ID NO: 7864 - RNA, 19 nt, artificial
  Chemically synthesized
uugccauccgaaauuauaa

SEQ ID NO: 7865 - RNA, 19 nt, artificial
  Chemically synthesized
uaucaccgucugaccgagc

SEQ ID NO: 7866 - RNA, 19 nt, artificial
  Chemically synthesized
cuuaugaagccuaauuucu

SEQ ID NO: 7867 - RNA, 19 nt, artificial
  Chemically synthesized
acugcagucaucaaguaga

SEQ ID NO: 7868 - RNA, 19 nt, artificial
  Chemically synthesized
ucauccuggcuugaguaga

SEQ ID NO: 7869 - RNA, 19 nt, artificial
  Chemically synthesized
caagcaaagucauucugag

SEQ ID NO: 7870 - RNA, 19 nt, artificial
  Chemically synthesized
aguuccuguuuuuuggaag

SEQ ID NO: 7871 - RNA, 19 nt, artificial
  Chemically synthesized
gguuccuugacugaguugg

SEQ ID NO: 7872 - RNA, 19 nt, artificial
  Chemically synthesized
agagaacucaucucaaaca

SEQ ID NO: 7873 - RNA, 19 nt, artificial
  Chemically synthesized
auaaggccugacauguggc

SEQ ID NO: 7874 - RNA, 19 nt, artificial
  Chemically synthesized
ucuaccauacuuuaugcag

SEQ ID NO: 7875 - RNA, 19 nt, artificial
  Chemically synthesized
augucaagguaaaugaggu

SEQ ID NO: 7876 - RNA, 19 nt, artificial
  Chemically synthesized
ucuaaagagagauugagua

SEQ ID NO: 7877 - RNA, 19 nt, artificial
  Chemically synthesized
ucgcuaucaccgucugacc

SEQ ID NO: 7878 - RNA, 19 nt, artificial
  Chemically synthesized
gauuuaagaaagcuagacu

SEQ ID NO: 7879 - RNA, 19 nt, artificial
  Chemically synthesized
ucccacuccagguaagugu

SEQ ID NO: 7880 - RNA, 19 nt, artificial
  Chemically synthesized
guguauucaaagcaguucu

SEQ ID NO: 7881 - RNA, 19 nt, artificial
  Chemically synthesized
uguggcagcauuuaauacu

SEQ ID NO: 7882 - RNA, 19 nt, artificial
  Chemically synthesized
uacccaguccucauccugg

SEQ ID NO: 7883 - RNA, 19 nt, artificial
  Chemically synthesized
aagaaaacgccugcagacc

SEQ ID NO: 7884 - RNA, 19 nt, artificial
  Chemically synthesized
gucaauaauaucaucgagg

SEQ ID NO: 7885 - RNA, 19 nt, artificial
  Chemically synthesized
uacuuugaaucuuguugcu

SEQ ID NO: 7886 - RNA, 19 nt, artificial
  Chemically synthesized
uggacuucuaaaccagcca

SEQ ID NO: 7887 - RNA, 19 nt, artificial
  Chemically synthesized
agcucugugaagauaucug

SEQ ID NO: 7888 - RNA, 19 nt, artificial
  Chemically synthesized
cacaaguacaagcaaaguc

SEQ ID NO: 7889 - RNA, 19 nt, artificial
  Chemically synthesized
uauucaucugacaggugau

SEQ ID NO: 7890 - RNA, 19 nt, artificial
  Chemically synthesized
cuucgagacuggacaagcc

SEQ ID NO: 7891 - RNA, 19 nt, artificial
  Chemically synthesized
ucaagaaaaggugaccucc

SEQ ID NO: 7892 - RNA, 19 nt, artificial
  Chemically synthesized
acacuucugacugugguca

SEQ ID NO: 7893 - RNA, 19 nt, artificial
  Chemically synthesized
uuucuggucucacgcagga

SEQ ID NO: 7894 - RNA, 19 nt, artificial
  Chemically synthesized
ugaguagauaacaaaggca

SEQ ID NO: 7895 - RNA, 19 nt, artificial
  Chemically synthesized
uucagagguccaucaaaca

SEQ ID NO: 7896 - RNA, 19 nt, artificial
  Chemically synthesized
ucuccagaagaugugccgc

SEQ ID NO: 7897 - RNA, 19 nt, artificial
  Chemically synthesized
caaguuucucagcucugug

SEQ ID NO: 7898 - RNA, 19 nt, artificial
  Chemically synthesized
ccuucacacguaguucucc

SEQ ID NO: 7899 - RNA, 19 nt, artificial
  Chemically synthesized
aaguuagaagaagaaaacg

SEQ ID NO: 7900 - RNA, 19 nt, artificial
  Chemically synthesized
cagggauguucaaucaccc

SEQ ID NO: 7901 - RNA, 19 nt, artificial
  Chemically synthesized
ugaggaggcuggaugaaca

SEQ ID NO: 7902 - RNA, 19 nt, artificial
  Chemically synthesized
caacaaucaccuuucggcu

SEQ ID NO: 7903 - RNA, 19 nt, artificial
  Chemically synthesized
aguuucugaggcacuggug

SEQ ID NO: 7904 - RNA, 19 nt, artificial
  Chemically synthesized
agaccuugaauacaaguuu

SEQ ID NO: 7905 - RNA, 19 nt, artificial
  Chemically synthesized
ucugguguucacaaguaca

SEQ ID NO: 7906 - RNA, 19 nt, artificial
  Chemically synthesized
uucaaacucagcacaggca

SEQ ID NO: 7907 - RNA, 19 nt, artificial
  Chemically synthesized
gagaugcuagauuugucuc

SEQ ID NO: 7908 - RNA, 19 nt, artificial
  Chemically synthesized
acagcaauguauacucccu

SEQ ID NO: 7909 - RNA, 19 nt, artificial
  Chemically synthesized
acacugagagagguccagg

SEQ ID NO: 7910 - RNA, 19 nt, artificial
  Chemically synthesized
ucacgcaggagaggaaggc

SEQ ID NO: 7911 - RNA, 19 nt, artificial
  Chemically synthesized
cuuccugccaauugcaucc

SEQ ID NO: 7912 - RNA, 19 nt, artificial
  Chemically synthesized
agcccaagaaguuugaacu

SEQ ID NO: 7913 - RNA, 19 nt, artificial
  Chemically synthesized
ucuaaguaugcuaaucgga

SEQ ID NO: 7914 - RNA, 19 nt, artificial
  Chemically synthesized
aaaccaaacacacucugaa

SEQ ID NO: 7915 - RNA, 19 nt, artificial
  Chemically synthesized
cauggaauuacucacccuu

SEQ ID NO: 7916 - RNA, 19 nt, artificial
  Chemically synthesized
augcucgagaaugaccagg

SEQ ID NO: 7917 - RNA, 19 nt, artificial
  Chemically synthesized
gaacuuauagaccagaacu

SEQ ID NO: 7918 - RNA, 19 nt, artificial
  Chemically synthesized
aacuguccaaauuuacagu

SEQ ID NO: 7919 - RNA, 19 nt, artificial
  Chemically synthesized
aggaauuagccacuagacu

SEQ ID NO: 7920 - RNA, 19 nt, artificial
  Chemically synthesized
guugaaaugacuuucuuug

SEQ ID NO: 7921 - RNA, 19 nt, artificial
  Chemically synthesized
uaagauugugagccacauu

SEQ ID NO: 7922 - RNA, 19 nt, artificial
  Chemically synthesized
auggaauuacucacccuua

SEQ ID NO: 7923 - RNA, 19 nt, artificial
  Chemically synthesized
guuccuucuggauuccaug

SEQ ID NO: 7924 - RNA, 19 nt, artificial
  Chemically synthesized
caagcauaagggauaaggg

SEQ ID NO: 7925 - RNA, 19 nt, artificial
  Chemically synthesized
ugaaaaagcauucccaccu

SEQ ID NO: 7926 - RNA, 19 nt, artificial
  Chemically synthesized
uuguuucaaauuggaaugc

SEQ ID NO: 7927 - RNA, 19 nt, artificial
  Chemically synthesized
aaagguccaagugcucuag

SEQ ID NO: 7928 - RNA, 19 nt, artificial
  Chemically synthesized
uaauuccagacacauuguu

SEQ ID NO: 7929 - RNA, 19 nt, artificial
  Chemically synthesized
acuggaagcuccuugagau

SEQ ID NO: 7930 - RNA, 19 nt, artificial
  Chemically synthesized
ugauugagacuguaaucaa

SEQ ID NO: 7931 - RNA, 19 nt, artificial
  Chemically synthesized
cacuccagguaaguguucc

SEQ ID NO: 7932 - RNA, 19 nt, artificial
  Chemically synthesized
uagaccugcucaaaccaaa

SEQ ID NO: 7933 - RNA, 19 nt, artificial
  Chemically synthesized
ugcugcuuucaugacaguc

SEQ ID NO: 7934 - RNA, 19 nt, artificial
  Chemically synthesized
aaaggcaucauagauguuu

SEQ ID NO: 7935 - RNA, 19 nt, artificial
  Chemically synthesized
auaacuuuggaaugacauc

SEQ ID NO: 7936 - RNA, 19 nt, artificial
  Chemically synthesized
caaugaagaugauaccagc

SEQ ID NO: 7937 - RNA, 19 nt, artificial
  Chemically synthesized
uuauucccucugcacugga

SEQ ID NO: 7938 - RNA, 19 nt, artificial
  Chemically synthesized
aacacucaguaacaaacac

SEQ ID NO: 7939 - RNA, 19 nt, artificial
  Chemically synthesized
auuucaaugcugcuuucau

SEQ ID NO: 7940 - RNA, 19 nt, artificial
  Chemically synthesized
acagauaugaucaugcgga

SEQ ID NO: 7941 - RNA, 19 nt, artificial
  Chemically synthesized
ccuuucaauagucacacuc

SEQ ID NO: 7942 - RNA, 19 nt, artificial
  Chemically synthesized
uucuccuggcagugagaag

SEQ ID NO: 7943 - RNA, 19 nt, artificial
  Chemically synthesized
gauccauugcaggaaacuc

SEQ ID NO: 7944 - RNA, 19 nt, artificial
  Chemically synthesized
uggaaugacaucgagugac

SEQ ID NO: 7945 - RNA, 19 nt, artificial
  Chemically synthesized
augagacauggaaacacac

SEQ ID NO: 7946 - RNA, 19 nt, artificial
  Chemically synthesized
aaugauaacauccacucuu

SEQ ID NO: 7947 - RNA, 19 nt, artificial
  Chemically synthesized
aagauugugagccacauua

SEQ ID NO: 7948 - RNA, 19 nt, artificial
  Chemically synthesized
acuguuccuucuggauucc

SEQ ID NO: 7949 - RNA, 19 nt, artificial
  Chemically synthesized
ggaauuacucacccuuagc

SEQ ID NO: 7950 - RNA, 19 nt, artificial
  Chemically synthesized
caggucuaaagagagauug

SEQ ID NO: 7951 - RNA, 19 nt, artificial
  Chemically synthesized
caagugcucuagauugguc

SEQ ID NO: 7952 - RNA, 19 nt, artificial
  Chemically synthesized
uccagguaaguguuccugc

SEQ ID NO: 7953 - RNA, 19 nt, artificial
  Chemically synthesized
cuucuaaaccagccagacc

SEQ ID NO: 7954 - RNA, 19 nt, artificial
  Chemically synthesized
uaguacaugagacauggaa

SEQ ID NO: 7955 - RNA, 19 nt, artificial
  Chemically synthesized
aagauuggauaagauugug

SEQ ID NO: 7956 - RNA, 19 nt, artificial
  Chemically synthesized
uucaaaguuuugagauguc

SEQ ID NO: 7957 - RNA, 19 nt, artificial
  Chemically synthesized
uugcuggaaagguccaagu

SEQ ID NO: 7958 - RNA, 19 nt, artificial
  Chemically synthesized
auucucccagaaccaaacg

SEQ ID NO: 7959 - RNA, 19 nt, artificial
  Chemically synthesized
ucugagugauaggaauacu

SEQ ID NO: 7960 - RNA, 19 nt, artificial
  Chemically synthesized
acaaaugcacacaucuacu

SEQ ID NO: 7961 - RNA, 19 nt, artificial
  Chemically synthesized
ucucaaugauaacauccac

SEQ ID NO: 7962 - RNA, 19 nt, artificial
  Chemically synthesized
acauucuuuucugggaacc

SEQ ID NO: 7963 - RNA, 19 nt, artificial
  Chemically synthesized
acacucucuucuauacaga

SEQ ID NO: 7964 - RNA, 19 nt, artificial
  Chemically synthesized
acaccaaugauggucuuau

SEQ ID NO: 7965 - RNA, 19 nt, artificial
  Chemically synthesized
uugccagccauuuucaaga

SEQ ID NO: 7966 - RNA, 19 nt, artificial
  Chemically synthesized
ugauccauugcaggaaacu

SEQ ID NO: 7967 - RNA, 19 nt, artificial
  Chemically synthesized
ucaaguuucucagcucugu

SEQ ID NO: 7968 - RNA, 19 nt, artificial
  Chemically synthesized
aggugauauucaaacucag

SEQ ID NO: 7969 - RNA, 19 nt, artificial
  Chemically synthesized
uuguccuuuucuugaaugu

SEQ ID NO: 7970 - RNA, 19 nt, artificial
  Chemically synthesized
ucuggaaucaagaaaaggu

SEQ ID NO: 7971 - RNA, 19 nt, artificial
  Chemically synthesized
guauucaaagcaguucugg

SEQ ID NO: 7972 - RNA, 19 nt, artificial
  Chemically synthesized
ugguugucccaaaaucacu

SEQ ID NO: 7973 - RNA, 19 nt, artificial
  Chemically synthesized
uaaacuugauaguccagaa

SEQ ID NO: 7974 - RNA, 19 nt, artificial
  Chemically synthesized
cuuccuuccugccucuagc

SEQ ID NO: 7975 - RNA, 19 nt, artificial
  Chemically synthesized
aggaaggucaaguuucuca

SEQ ID NO: 7976 - RNA, 19 nt, artificial
  Chemically synthesized
ccuucauggaugauguugg

SEQ ID NO: 7977 - RNA, 19 nt, artificial
  Chemically synthesized
cuugguagaucaacuucug

SEQ ID NO: 7978 - RNA, 19 nt, artificial
  Chemically synthesized
aaagcuagacuacuuggaa

SEQ ID NO: 7979 - RNA, 19 nt, artificial
  Chemically synthesized
caaagauacaccagcggcu

SEQ ID NO: 7980 - RNA, 19 nt, artificial
  Chemically synthesized
agaccagaacugcuacaac

SEQ ID NO: 7981 - RNA, 19 nt, artificial
  Chemically synthesized
acugcucagaaacugccag

SEQ ID NO: 7982 - RNA, 19 nt, artificial
  Chemically synthesized
uccaccaagagcugccucu

SEQ ID NO: 7983 - RNA, 19 nt, artificial
  Chemically synthesized
cacacuuucaaauacacac

SEQ ID NO: 7984 - RNA, 19 nt, artificial
  Chemically synthesized
cuuugaaucuuguugcugg

SEQ ID NO: 7985 - RNA, 19 nt, artificial
  Chemically synthesized
gaaacacucaguaacaaac

SEQ ID NO: 7986 - RNA, 19 nt, artificial
  Chemically synthesized
auuuuuccucuucagauag

SEQ ID NO: 7987 - RNA, 19 nt, artificial
  Chemically synthesized
ucuacuuucacuaguacau

SEQ ID NO: 7988 - RNA, 19 nt, artificial
  Chemically synthesized
aacucaaggcuugguagau

SEQ ID NO: 7989 - RNA, 19 nt, artificial
  Chemically synthesized
acaagcacacugaggaccg

SEQ ID NO: 7990 - RNA, 19 nt, artificial
  Chemically synthesized
caaccuuagcauucuggac

SEQ ID NO: 7991 - RNA, 19 nt, artificial
  Chemically synthesized
acuuucaaauacacacagc

SEQ ID NO: 7992 - RNA, 19 nt, artificial
  Chemically synthesized
uugauccauugcaggaaac

SEQ ID NO: 7993 - RNA, 19 nt, artificial
  Chemically synthesized
ugauaggaauacugaaaac

SEQ ID NO: 7994 - RNA, 19 nt, artificial
  Chemically synthesized
accagaacugcuacaacag

SEQ ID NO: 7995 - RNA, 19 nt, artificial
  Chemically synthesized
agagagguggcuuaggcuc

SEQ ID NO: 7996 - RNA, 19 nt, artificial
  Chemically synthesized
ugcccugcuuaucugaagg

SEQ ID NO: 7997 - RNA, 19 nt, artificial
  Chemically synthesized
ucuucaauugucuggauuu

SEQ ID NO: 7998 - RNA, 19 nt, artificial
  Chemically synthesized
ucauuaugugauugagacu

SEQ ID NO: 7999 - RNA, 19 nt, artificial
  Chemically synthesized
gaaccuucuuuauaagaac

SEQ ID NO: 8000 - RNA, 19 nt, artificial
  Chemically synthesized
gucuccacagccaccagcu

SEQ ID NO: 8001 - RNA, 19 nt, artificial
  Chemically synthesized
ugggcuaaagggugagagg

SEQ ID NO: 8002 - RNA, 19 nt, artificial
  Chemically synthesized
gacaccacaacaaucaccu

SEQ ID NO: 8003 - RNA, 19 nt, artificial
  Chemically synthesized
aggucaucccacuuccuuc

SEQ ID NO: 8004 - RNA, 19 nt, artificial
  Chemically synthesized
aucggaauucuucaauggu

SEQ ID NO: 8005 - RNA, 19 nt, artificial
  Chemically synthesized
aagccauugaagaugccau

SEQ ID NO: 8006 - RNA, 19 nt, artificial
  Chemically synthesized
aagcacacugaggaccgac

SEQ ID NO: 8007 - RNA, 19 nt, artificial
  Chemically synthesized
acuacuuggaaaaugcugu

SEQ ID NO: 8008 - RNA, 19 nt, artificial
  Chemically synthesized
aggucaaguuucucagcuc

SEQ ID NO: 8009 - RNA, 19 nt, artificial
  Chemically synthesized
ucaaauacacacagcccug

SEQ ID NO: 8010 - RNA, 19 nt, artificial
  Chemically synthesized
ugugaagauaucuggaagg

SEQ ID NO: 8011 - RNA, 19 nt, artificial
  Chemically synthesized
aaagagauucagaggucca

SEQ ID NO: 8012 - RNA, 19 nt, artificial
  Chemically synthesized
agugaguuaaaugcuguug

SEQ ID NO: 8013 - RNA, 19 nt, artificial
  Chemically synthesized
aaaugcaccugguuggaua

SEQ ID NO: 8014 - RNA, 19 nt, artificial
  Chemically synthesized
uauuuaguaccugaagacu

SEQ ID NO: 8015 - RNA, 19 nt, artificial
  Chemically synthesized
cuacugagaucuagaaacu

SEQ ID NO: 8016 - RNA, 19 nt, artificial
  Chemically synthesized
uugcuuccugccaauugca

SEQ ID NO: 8017 - RNA, 19 nt, artificial
  Chemically synthesized
uccagaagaugugccgccc

SEQ ID NO: 8018 - RNA, 19 nt, artificial
  Chemically synthesized
ucuaaauacuuuaggcugg

SEQ ID NO: 8019 - RNA, 19 nt, artificial
  Chemically synthesized
gauggcuauaacauaauac

SEQ ID NO: 8020 - RNA, 19 nt, artificial
  Chemically synthesized
cagagguccaucaaacauc

SEQ ID NO: 8021 - RNA, 19 nt, artificial
  Chemically synthesized
caaugugggaaacugucca

SEQ ID NO: 8022 - RNA, 19 nt, artificial
  Chemically synthesized
uuuuccaaguuuccuucau

SEQ ID NO: 8023 - RNA, 19 nt, artificial
  Chemically synthesized
uguuucaaauuggaaugcu

SEQ ID NO: 8024 - RNA, 19 nt, artificial
  Chemically synthesized
aauguugccauccgaaauu

SEQ ID NO: 8025 - RNA, 19 nt, artificial
  Chemically synthesized
ugaacucaugguaauaaca

SEQ ID NO: 8026 - RNA, 19 nt, artificial
  Chemically synthesized
ucaugcggacacacacacu

SEQ ID NO: 8027 - RNA, 19 nt, artificial
  Chemically synthesized
aaugacuuucuuugucaug

SEQ ID NO: 8028 - RNA, 19 nt, artificial
  Chemically synthesized
ggucagauuagaaaaauac

SEQ ID NO: 8029 - RNA, 19 nt, artificial
  Chemically synthesized
ucuggacuuuuguuucucu

SEQ ID NO: 8030 - RNA, 19 nt, artificial
  Chemically synthesized
ugcaccugguuggauaaag

SEQ ID NO: 8031 - RNA, 19 nt, artificial
  Chemically synthesized
accugcucaaaccaaacac

SEQ ID NO: 8032 - RNA, 19 nt, artificial
  Chemically synthesized
acacuuauaaggaaacgua

SEQ ID NO: 8033 - RNA, 19 nt, artificial
  Chemically synthesized
auuagcuuauaggcaagac

SEQ ID NO: 8034 - RNA, 19 nt, artificial
  Chemically synthesized
ucucacgcaggagaggaag

SEQ ID NO: 8035 - RNA, 19 nt, artificial
  Chemically synthesized
aaugcccaccuggaagacu

SEQ ID NO: 8036 - RNA, 19 nt, artificial
  Chemically synthesized
uuccuugacugaguugguu

SEQ ID NO: 8037 - RNA, 19 nt, artificial
  Chemically synthesized
ggaaggucaaguuucucag

SEQ ID NO: 8038 - RNA, 19 nt, artificial
  Chemically synthesized
agugauaggaauacugaaa

SEQ ID NO: 8039 - RNA, 19 nt, artificial
  Chemically synthesized
accuucugcaggacaauga

SEQ ID NO: 8040 - RNA, 19 nt, artificial
  Chemically synthesized
uuuccaaguuuccuucauu

SEQ ID NO: 8041 - RNA, 19 nt, artificial
  Chemically synthesized
uagaacuuauagaccagaa

SEQ ID NO: 8042 - RNA, 19 nt, artificial
  Chemically synthesized
acacucugaaacacucagu

SEQ ID NO: 8043 - RNA, 19 nt, artificial
  Chemically synthesized
ucugaaaaagcauucccac

SEQ ID NO: 8044 - RNA, 19 nt, artificial
  Chemically synthesized
ugcuccaguugacacugag

SEQ ID NO: 8045 - RNA, 19 nt, artificial
  Chemically synthesized
cuuaggcucugauaugccc

SEQ ID NO: 8046 - RNA, 19 nt, artificial
  Chemically synthesized
gugaguuaaaugcuguugg

SEQ ID NO: 8047 - RNA, 19 nt, artificial
  Chemically synthesized
uugguagaucaacuucuga

SEQ ID NO: 8048 - RNA, 19 nt, artificial
  Chemically synthesized
ucucuuuugucacaggaga

SEQ ID NO: 8049 - RNA, 19 nt, artificial
  Chemically synthesized
gaaguuagaagaagaaaac

SEQ ID NO: 8050 - RNA, 19 nt, artificial
  Chemically synthesized
gagaacucaucucaaacag

SEQ ID NO: 8051 - RNA, 19 nt, artificial
  Chemically synthesized
aagucauucugaguaagau

SEQ ID NO: 8052 - RNA, 19 nt, artificial
  Chemically synthesized
auggguuccuugacugagu

SEQ ID NO: 8053 - RNA, 19 nt, artificial
  Chemically synthesized
acuuugaaucuuguugcug

SEQ ID NO: 8054 - RNA, 19 nt, artificial
  Chemically synthesized
ucugguccuugauccauug

SEQ ID NO: 8055 - RNA, 19 nt, artificial
  Chemically synthesized
ucguucaacuuccaccaag

SEQ ID NO: 8056 - RNA, 19 nt, artificial
  Chemically synthesized
guuaucucuuuugucacag

SEQ ID NO: 8057 - RNA, 19 nt, artificial
  Chemically synthesized
uugucaaacuuuuccaagu

SEQ ID NO: 8058 - RNA, 19 nt, artificial
  Chemically synthesized
ucaacuucugaaaaagcau

SEQ ID NO: 8059 - RNA, 19 nt, artificial
  Chemically synthesized
uuccaguuuugacaacuga

SEQ ID NO: 8060 - RNA, 19 nt, artificial
  Chemically synthesized
aagacucaggaaaagaaca

SEQ ID NO: 8061 - RNA, 19 nt, artificial
  Chemically synthesized
auccacucuucccaaaaug

SEQ ID NO: 8062 - RNA, 19 nt, artificial
  Chemically synthesized
agaggaaguuagaagaaga

SEQ ID NO: 8063 - RNA, 19 nt, artificial
  Chemically synthesized
caacugaauuuuguugucu

SEQ ID NO: 8064 - RNA, 19 nt, artificial
  Chemically synthesized
aagaccaggaagcggaaau

SEQ ID NO: 8065 - RNA, 19 nt, artificial
  Chemically synthesized
acaagcacaagaguagaga

SEQ ID NO: 8066 - RNA, 19 nt, artificial
  Chemically synthesized
cacacucucuucuauacag

SEQ ID NO: 8067 - RNA, 19 nt, artificial
  Chemically synthesized
aaugcguggcucgcuauca

SEQ ID NO: 8068 - RNA, 19 nt, artificial
  Chemically synthesized
ugcacaggcccucuagagc

SEQ ID NO: 8069 - RNA, 19 nt, artificial
  Chemically synthesized
cauugcaggaaacucuggu

SEQ ID NO: 8070 - RNA, 19 nt, artificial
  Chemically synthesized
ucuugaauguucuguuucu

SEQ ID NO: 8071 - RNA, 19 nt, artificial
  Chemically synthesized
aaaaagugaacacccaguu

SEQ ID NO: 8072 - RNA, 19 nt, artificial
  Chemically synthesized
accgacacaccaaugaugg

SEQ ID NO: 8073 - RNA, 19 nt, artificial
  Chemically synthesized
ugugggaaacuguccaaau

SEQ ID NO: 8074 - RNA, 19 nt, artificial
  Chemically synthesized
uuuucaccucuaccauacu

SEQ ID NO: 8075 - RNA, 19 nt, artificial
  Chemically synthesized
ugugaaugcguggcucgcu

SEQ ID NO: 8076 - RNA, 19 nt, artificial
  Chemically synthesized
aaacuuuuccaaguuuccu

SEQ ID NO: 8077 - RNA, 19 nt, artificial
  Chemically synthesized
auguguuaaucagguuucc

SEQ ID NO: 8078 - RNA, 19 nt, artificial
  Chemically synthesized
uuugauguagaacccgcaa

SEQ ID NO: 8079 - RNA, 19 nt, artificial
  Chemically synthesized
auaaaguucauaggguuca

SEQ ID NO: 8080 - RNA, 19 nt, artificial
  Chemically synthesized
ugggacaccacaacaauca

SEQ ID NO: 8081 - RNA, 19 nt, artificial
  Chemically synthesized
auuccagacacauuguuuu

SEQ ID NO: 8082 - RNA, 19 nt, artificial
  Chemically synthesized
agaacugcuacaacagaua

SEQ ID NO: 8083 - RNA, 19 nt, artificial
  Chemically synthesized
ugcaacucauuucaugagg

SEQ ID NO: 8084 - RNA, 19 nt, artificial
  Chemically synthesized
ucuggucucacgcaggaga

SEQ ID NO: 8085 - RNA, 19 nt, artificial
  Chemically synthesized
gauaugugcacaaaugcac

SEQ ID NO: 8086 - RNA, 19 nt, artificial
  Chemically synthesized
cugauagggauacauaggg

SEQ ID NO: 8087 - RNA, 19 nt, artificial
  Chemically synthesized
ucaucgagguaguagucua

SEQ ID NO: 8088 - RNA, 19 nt, artificial
  Chemically synthesized
aucuggaaggaaguuuucc

SEQ ID NO: 8089 - RNA, 19 nt, artificial
  Chemically synthesized
ucugacuguggucauauuu

SEQ ID NO: 8090 - RNA, 19 nt, artificial
  Chemically synthesized
ugauagggauacauaggga

SEQ ID NO: 8091 - RNA, 19 nt, artificial
  Chemically synthesized
gcuucuguaaacuugauag

SEQ ID NO: 8092 - RNA, 19 nt, artificial
  Chemically synthesized
augauaacauccacucuuc

SEQ ID NO: 8093 - RNA, 19 nt, artificial
  Chemically synthesized
gucauuaugugauugagac

SEQ ID NO: 8094 - RNA, 19 nt, artificial
  Chemically synthesized
cauaucuagugcaccaugg

SEQ ID NO: 8095 - RNA, 19 nt, artificial
  Chemically synthesized
ugucauggguuccuugacu

SEQ ID NO: 8096 - RNA, 19 nt, artificial
  Chemically synthesized
uuccaccaagagcugccuc

SEQ ID NO: 8097 - RNA, 19 nt, artificial
  Chemically synthesized
acuuuaugcagccagcaag

SEQ ID NO: 8098 - RNA, 19 nt, artificial
  Chemically synthesized
gcaucauagauguuuucac

SEQ ID NO: 8099 - RNA, 19 nt, artificial
  Chemically synthesized
cuccuugagauuagcagcc

SEQ ID NO: 8100 - RNA, 19 nt, artificial
  Chemically synthesized
ugggaucagagucccagcc

SEQ ID NO: 8101 - RNA, 19 nt, artificial
  Chemically synthesized
gcaccauggaauuacucac

SEQ ID NO: 8102 - RNA, 19 nt, artificial
  Chemically synthesized
accaaacacacucugaaac

SEQ ID NO: 8103 - RNA, 19 nt, artificial
  Chemically synthesized
gauaggaauacugaaaacu

SEQ ID NO: 8104 - RNA, 19 nt, artificial
  Chemically synthesized
ugcccaacaggaaacagca

SEQ ID NO: 8105 - RNA, 19 nt, artificial
  Chemically synthesized
guucuaguuguucuaagcc

SEQ ID NO: 8106 - RNA, 19 nt, artificial
  Chemically synthesized
auucuuuucugggaaccuu

SEQ ID NO: 8107 - RNA, 19 nt, artificial
  Chemically synthesized
agaguugaaaugacuuucu

SEQ ID NO: 8108 - RNA, 19 nt, artificial
  Chemically synthesized
uauuugaagcacgucuuaa

SEQ ID NO: 8109 - RNA, 19 nt, artificial
  Chemically synthesized
caauggucaaauugcacag

SEQ ID NO: 8110 - RNA, 19 nt, artificial
  Chemically synthesized
auuucucccuuccuccuuu

SEQ ID NO: 8111 - RNA, 19 nt, artificial
  Chemically synthesized
uuagcauaaggccugacau

SEQ ID NO: 8112 - RNA, 19 nt, artificial
  Chemically synthesized
uucacaccuccacgcaggg

SEQ ID NO: 8113 - RNA, 19 nt, artificial
  Chemically synthesized
ugguguucacaaguacaag

SEQ ID NO: 8114 - RNA, 19 nt, artificial
  Chemically synthesized
ugguugaaaugcccaccug

SEQ ID NO: 8115 - RNA, 19 nt, artificial
  Chemically synthesized
aaacaucacuuguucugaa

SEQ ID NO: 8116 - RNA, 19 nt, artificial
  Chemically synthesized
aucaacuucugaaaaagca

SEQ ID NO: 8117 - RNA, 19 nt, artificial
  Chemically synthesized
caucccacuuccuuccugc

SEQ ID NO: 8118 - RNA, 19 nt, artificial
  Chemically synthesized
acaggaaacagcaauguau

SEQ ID NO: 8119 - RNA, 19 nt, artificial
  Chemically synthesized
agugcucuagauuggucag

SEQ ID NO: 8120 - RNA, 19 nt, artificial
  Chemically synthesized
acaacagauacuacaagca

SEQ ID NO: 8121 - RNA, 19 nt, artificial
  Chemically synthesized
ucuagagaugcuagauuug

SEQ ID NO: 8122 - RNA, 19 nt, artificial
  Chemically synthesized
ucuaaauguugccauccga

SEQ ID NO: 8123 - RNA, 19 nt, artificial
  Chemically synthesized
acacucaccagggaaaaug

SEQ ID NO: 8124 - RNA, 19 nt, artificial
  Chemically synthesized
accagcuucuguaaacuug

SEQ ID NO: 8125 - RNA, 19 nt, artificial
  Chemically synthesized
accgggaauaaagucucug

SEQ ID NO: 8126 - RNA, 19 nt, artificial
  Chemically synthesized
agacauggaaacacaccca

SEQ ID NO: 8127 - RNA, 19 nt, artificial
  Chemically synthesized
auguucuguuucugaggag

SEQ ID NO: 8128 - RNA, 19 nt, artificial
  Chemically synthesized
ugaaagcaacucuggugug

SEQ ID NO: 8129 - RNA, 19 nt, artificial
  Chemically synthesized
uaacaaaggcaucauagau

SEQ ID NO: 8130 - RNA, 19 nt, artificial
  Chemically synthesized
uggauuucacaccuccacg

SEQ ID NO: 8131 - RNA, 19 nt, artificial
  Chemically synthesized
uuguuguggcucauauuua

SEQ ID NO: 8132 - RNA, 19 nt, artificial
  Chemically synthesized
accugguuggauaaaguuc

SEQ ID NO: 8133 - RNA, 19 nt, artificial
  Chemically synthesized
ucuggaaggaaguuuuccu

SEQ ID NO: 8134 - RNA, 19 nt, artificial
  Chemically synthesized
agcacaagaguagagaacu

SEQ ID NO: 8135 - RNA, 19 nt, artificial
  Chemically synthesized
gaauguucuguuucugagg

SEQ ID NO: 8136 - RNA, 19 nt, artificial
  Chemically synthesized
uuucugagugauaggaaua

SEQ ID NO: 8137 - RNA, 19 nt, artificial
  Chemically synthesized
aucacuuugagaacagcaa

SEQ ID NO: 8138 - RNA, 19 nt, artificial
  Chemically synthesized
aaagcauucccaccuuugu

SEQ ID NO: 8139 - RNA, 19 nt, artificial
  Chemically synthesized
ggaggcuggaugaacauuc

SEQ ID NO: 8140 - RNA, 19 nt, artificial
  Chemically synthesized
uacacacagcccugauagg

SEQ ID NO: 8141 - RNA, 19 nt, artificial
  Chemically synthesized
agaacagcaaccuuugaaa

SEQ ID NO: 8142 - RNA, 19 nt, artificial
  Chemically synthesized
cauauucaaagauacacca

SEQ ID NO: 8143 - RNA, 19 nt, artificial
  Chemically synthesized
cagggcuaaacucuggaug

SEQ ID NO: 8144 - RNA, 19 nt, artificial
  Chemically synthesized
acagccaccagcuucugua

SEQ ID NO: 8145 - RNA, 19 nt, artificial
  Chemically synthesized
gucuuauucaucugacagg

SEQ ID NO: 8146 - RNA, 19 nt, artificial
  Chemically synthesized
caauuagacaacucccuau

SEQ ID NO: 8147 - RNA, 19 nt, artificial
  Chemically synthesized
auuugaagcacgucuuaaa

SEQ ID NO: 8148 - RNA, 19 nt, artificial
  Chemically synthesized
aagccauuucuacugagau

SEQ ID NO: 8149 - RNA, 19 nt, artificial
  Chemically synthesized
uccacagccaccagcuucu

SEQ ID NO: 8150 - RNA, 19 nt, artificial
  Chemically synthesized
ugcacuggaagcuccuuga

SEQ ID NO: 8151 - RNA, 19 nt, artificial
  Chemically synthesized
caauagucacacucaccag

SEQ ID NO: 8152 - RNA, 19 nt, artificial
  Chemically synthesized
auacucccugccuugaaua

SEQ ID NO: 8153 - RNA, 19 nt, artificial
  Chemically synthesized
aaguuucucagcucuguga

SEQ ID NO: 8154 - RNA, 19 nt, artificial
  Chemically synthesized
ugcucgagaaugaccagga

SEQ ID NO: 8155 - RNA, 19 nt, artificial
  Chemically synthesized
caaacuuuuccaaguuucc

SEQ ID NO: 8156 - RNA, 19 nt, artificial
  Chemically synthesized
auccagauguucuaguugu

SEQ ID NO: 8157 - RNA, 19 nt, artificial
  Chemically synthesized
augcccugcuuaucugaag

SEQ ID NO: 8158 - RNA, 19 nt, artificial
  Chemically synthesized
aaguuguuguggcucauau

SEQ ID NO: 8159 - RNA, 19 nt, artificial
  Chemically synthesized
gauaugaucaugcggacac

SEQ ID NO: 8160 - RNA, 19 nt, artificial
  Chemically synthesized
ugucuggauuucacaccuc

SEQ ID NO: 8161 - RNA, 19 nt, artificial
  Chemically synthesized
aguaccugaagacuggaga

SEQ ID NO: 8162 - RNA, 19 nt, artificial
  Chemically synthesized
guggcucauauuuaguacc

SEQ ID NO: 8163 - RNA, 19 nt, artificial
  Chemically synthesized
uacuuaguaggcaauaacu

SEQ ID NO: 8164 - RNA, 19 nt, artificial
  Chemically synthesized
uggaaugcuggaaauccag

SEQ ID NO: 8165 - RNA, 19 nt, artificial
  Chemically synthesized
aaaagugaacacccaguuc

SEQ ID NO: 8166 - RNA, 19 nt, artificial
  Chemically synthesized
caucaaacaucacuuguuc

SEQ ID NO: 8167 - RNA, 19 nt, artificial
  Chemically synthesized
augauaagaccaggaagcg

SEQ ID NO: 8168 - RNA, 19 nt, artificial
  Chemically synthesized
uucugagucgucuccagaa

SEQ ID NO: 8169 - RNA, 19 nt, artificial
  Chemically synthesized
ugaaaacucacucauuugu

SEQ ID NO: 8170 - RNA, 19 nt, artificial
  Chemically synthesized
agcacgucuuaaacaaccu

SEQ ID NO: 8171 - RNA, 19 nt, artificial
  Chemically synthesized
agcaauguauacucccugc

SEQ ID NO: 8172 - RNA, 19 nt, artificial
  Chemically synthesized
acugcuucugugagcagca

SEQ ID NO: 8173 - RNA, 19 nt, artificial
  Chemically synthesized
gaagcucagaucuaaauac

SEQ ID NO: 8174 - RNA, 19 nt, artificial
  Chemically synthesized
cauucuggacuuuuguuuc

SEQ ID NO: 8175 - RNA, 19 nt, artificial
  Chemically synthesized
ucauccuggcaucauccuc

SEQ ID NO: 8176 - RNA, 19 nt, artificial
  Chemically synthesized
caucgagugacaaagugac

SEQ ID NO: 8177 - RNA, 19 nt, artificial
  Chemically synthesized
uuuugucacaggagaggaa

SEQ ID NO: 8178 - RNA, 19 nt, artificial
  Chemically synthesized
cucucuucuauacagauau

SEQ ID NO: 8179 - RNA, 19 nt, artificial
  Chemically synthesized
ucugagcaaucucauauuc

SEQ ID NO: 8180 - RNA, 19 nt, artificial
  Chemically synthesized
ucaauaauaucaucgaggu

SEQ ID NO: 8181 - RNA, 19 nt, artificial
  Chemically synthesized
cugugcaauaaauacuuug

SEQ ID NO: 8182 - RNA, 19 nt, artificial
  Chemically synthesized
accuugaauacaaguuuuc

SEQ ID NO: 8183 - RNA, 19 nt, artificial
  Chemically synthesized
gccuugaauaccuucacac

SEQ ID NO: 8184 - RNA, 19 nt, artificial
  Chemically synthesized
auccugauuguccuuuucu

SEQ ID NO: 8185 - RNA, 19 nt, artificial
  Chemically synthesized
gauugagacuguaaucaag

SEQ ID NO: 8186 - RNA, 19 nt, artificial
  Chemically synthesized
acaagcaaagucauucuga

SEQ ID NO: 8187 - RNA, 19 nt, artificial
  Chemically synthesized
acauggaaacacacccagg

SEQ ID NO: 8188 - RNA, 19 nt, artificial
  Chemically synthesized
uacugaaaacucacucauu

SEQ ID NO: 8189 - RNA, 19 nt, artificial
  Chemically synthesized
aaagucauucugaguaaga

SEQ ID NO: 8190 - RNA, 19 nt, artificial
  Chemically synthesized
aagaaaagucuuuuacccu

SEQ ID NO: 8191 - RNA, 19 nt, artificial
  Chemically synthesized
aucuucaauugucuggauu

SEQ ID NO: 8192 - RNA, 19 nt, artificial
  Chemically synthesized
aucauccucacugcuucug

SEQ ID NO: 8193 - RNA, 19 nt, artificial
  Chemically synthesized
aagucuuuuacccuuucaa

SEQ ID NO: 8194 - RNA, 19 nt, artificial
  Chemically synthesized
caaggcuugguagaucaac

SEQ ID NO: 8195 - RNA, 19 nt, artificial
  Chemically synthesized
ccagccaucugugucuccc

SEQ ID NO: 8196 - RNA, 19 nt, artificial
  Chemically synthesized
cauuucuacugagaucuag

SEQ ID NO: 8197 - RNA, 19 nt, artificial
  Chemically synthesized
ugaccuccugaggucaucc

SEQ ID NO: 8198 - RNA, 19 nt, artificial
  Chemically synthesized
aaucuuguugcuggaaagg

SEQ ID NO: 8199 - RNA, 19 nt, artificial
  Chemically synthesized
augaccaggaugguuguga

SEQ ID NO: 8200 - RNA, 19 nt, artificial
  Chemically synthesized
guugcuuccugccaauugc

SEQ ID NO: 8201 - RNA, 19 nt, artificial
  Chemically synthesized
aucccacuuccuuccugcc

SEQ ID NO: 8202 - RNA, 19 nt, artificial
  Chemically synthesized
uguugcacauuccauucgu

SEQ ID NO: 8203 - RNA, 19 nt, artificial
  Chemically synthesized
uccuggaaagaauugccag

SEQ ID NO: 8204 - RNA, 19 nt, artificial
  Chemically synthesized
aaacgccugcagaccagug

SEQ ID NO: 8205 - RNA, 19 nt, artificial
  Chemically synthesized
ugaagugcugggacaccac

SEQ ID NO: 8206 - RNA, 19 nt, artificial
  Chemically synthesized
aauagaacaugcucgagaa

SEQ ID NO: 8207 - RNA, 19 nt, artificial
  Chemically synthesized
gauuugucaaacuuuucca

SEQ ID NO: 8208 - RNA, 19 nt, artificial
  Chemically synthesized
uccuuaggaauuagccacu

SEQ ID NO: 8209 - RNA, 19 nt, artificial
  Chemically synthesized
aaucaagaaaaggugaccu

SEQ ID NO: 8210 - RNA, 19 nt, artificial
  Chemically synthesized
cacccagggauguucaauc

SEQ ID NO: 8211 - RNA, 19 nt, artificial
  Chemically synthesized
aucaucgagguaguagucu

SEQ ID NO: 8212 - RNA, 19 nt, artificial
  Chemically synthesized
uaaauucucccagaaccaa

SEQ ID NO: 8213 - RNA, 19 nt, artificial
  Chemically synthesized
ucucuucuauacagauaug

SEQ ID NO: 8214 - RNA, 19 nt, artificial
  Chemically synthesized
aaaagacucaggaaaagaa

SEQ ID NO: 8215 - RNA, 19 nt, artificial
  Chemically synthesized
ggauauuugaagcacgucu

SEQ ID NO: 8216 - RNA, 19 nt, artificial
  Chemically synthesized
cuucuccaccuucugcagg

SEQ ID NO: 8217 - RNA, 19 nt, artificial
  Chemically synthesized
auagaacuuauagaccaga

SEQ ID NO: 8218 - RNA, 19 nt, artificial
  Chemically synthesized
augagguaagaguugaaau

SEQ ID NO: 8219 - RNA, 19 nt, artificial
  Chemically synthesized
aaacguauccaaugaaaag

SEQ ID NO: 8220 - RNA, 19 nt, artificial
  Chemically synthesized
acauuccauucguucaacu

SEQ ID NO: 8221 - RNA, 19 nt, artificial
  Chemically synthesized
ugaaggcagagcugaaaug

SEQ ID NO: 8222 - RNA, 19 nt, artificial
  Chemically synthesized
auugcccaacaggaaacag

SEQ ID NO: 8223 - RNA, 19 nt, artificial
  Chemically synthesized
cacuguuccuucuggauuc

SEQ ID NO: 8224 - RNA, 19 nt, artificial
  Chemically synthesized
ucaaugcugcuuucaugac

SEQ ID NO: 8225 - RNA, 19 nt, artificial
  Chemically synthesized
guuggauaaaguucauagg

SEQ ID NO: 8226 - RNA, 19 nt, artificial
  Chemically synthesized
uacuuggaaaaugcuguag

SEQ ID NO: 8227 - RNA, 19 nt, artificial
  Chemically synthesized
gcuagauuugucuccacag

SEQ ID NO: 8228 - RNA, 19 nt, artificial
  Chemically synthesized
ucccucugcacuggaagcu

SEQ ID NO: 8229 - RNA, 19 nt, artificial
  Chemically synthesized
uccuguacccacuguuccu

SEQ ID NO: 8230 - RNA, 19 nt, artificial
  Chemically synthesized
uugaugagguaagaguuga

SEQ ID NO: 8231 - RNA, 19 nt, artificial
  Chemically synthesized
cacucuucccaaaaugugg

SEQ ID NO: 8232 - RNA, 19 nt, artificial
  Chemically synthesized
uuucuggaaucaagaaaag

SEQ ID NO: 8233 - RNA, 19 nt, artificial
  Chemically synthesized
gaacagcaaccuuugaaac

SEQ ID NO: 8234 - RNA, 19 nt, artificial
  Chemically synthesized
ucuguagugaaggcagagc

SEQ ID NO: 8235 - RNA, 19 nt, artificial
  Chemically synthesized
aagcuccuugagauuagca

SEQ ID NO: 8236 - RNA, 19 nt, artificial
  Chemically synthesized
acucaugguaauaacacca

SEQ ID NO: 8237 - RNA, 19 nt, artificial
  Chemically synthesized
uacuuucacuaguacauga

SEQ ID NO: 8238 - RNA, 19 nt, artificial
  Chemically synthesized
aauacuuuaggcugguugu

SEQ ID NO: 8239 - RNA, 19 nt, artificial
  Chemically synthesized
aucuacuuucacuaguaca

SEQ ID NO: 8240 - RNA, 19 nt, artificial
  Chemically synthesized
agauuggauaagauuguga

SEQ ID NO: 8241 - RNA, 19 nt, artificial
  Chemically synthesized
cucauauucaaagauacac

SEQ ID NO: 8242 - RNA, 19 nt, artificial
  Chemically synthesized
cacaccuccacgcagggcu

SEQ ID NO: 8243 - RNA, 19 nt, artificial
  Chemically synthesized
gauuugaguuucaaugugg

SEQ ID NO: 8244 - RNA, 19 nt, artificial
  Chemically synthesized
uugacugaguugguugaaa

SEQ ID NO: 8245 - RNA, 19 nt, artificial
  Chemically synthesized
aauguggucaaggagcauu

SEQ ID NO: 8246 - RNA, 19 nt, artificial
  Chemically synthesized
uuugaaucuuguugcugga

SEQ ID NO: 8247 - RNA, 19 nt, artificial
  Chemically synthesized
ucuucucuuccucgagccg

SEQ ID NO: 8248 - RNA, 19 nt, artificial
  Chemically synthesized
caaacacuucugacugugg

SEQ ID NO: 8249 - RNA, 19 nt, artificial
  Chemically synthesized
agguguugcacauuccauu

SEQ ID NO: 8250 - RNA, 19 nt, artificial
  Chemically synthesized
caaagugacagaguguacu

SEQ ID NO: 8251 - RNA, 19 nt, artificial
  Chemically synthesized
cuuuucuugaauguucugu

SEQ ID NO: 8252 - RNA, 19 nt, artificial
  Chemically synthesized
acaacugaauuuuguuguc

SEQ ID NO: 8253 - RNA, 19 nt, artificial
  Chemically synthesized
ucuuaaagucagcuuauga

SEQ ID NO: 8254 - RNA, 19 nt, artificial
  Chemically synthesized
auuagacaacucccuauuu

SEQ ID NO: 8255 - RNA, 19 nt, artificial
  Chemically synthesized
gaucuaaauacuuuaggcu

SEQ ID NO: 8256 - RNA, 19 nt, artificial
  Chemically synthesized
gucaaaacuaccaaaaugg

SEQ ID NO: 8257 - RNA, 19 nt, artificial
  Chemically synthesized
gauacuacaagcacacuga

SEQ ID NO: 8258 - RNA, 19 nt, artificial
  Chemically synthesized
gaacaaugucucuuucugu

SEQ ID NO: 8259 - RNA, 19 nt, artificial
  Chemically synthesized
gucucuguagugaaggcag

SEQ ID NO: 8260 - RNA, 19 nt, artificial
  Chemically synthesized
aagugaacacccaguucag

SEQ ID NO: 8261 - RNA, 19 nt, artificial
  Chemically synthesized
aaagucuuuuacccuuuca

SEQ ID NO: 8262 - RNA, 19 nt, artificial
  Chemically synthesized
gauaacauccacucuuccc

SEQ ID NO: 8263 - RNA, 19 nt, artificial
  Chemically synthesized
gagcagggucuucuccacc

SEQ ID NO: 8264 - RNA, 19 nt, artificial
  Chemically synthesized
gauguuggcagcaauggcc

SEQ ID NO: 8265 - RNA, 19 nt, artificial
  Chemically synthesized
uuucucccuuccuccuuuu

SEQ ID NO: 8266 - RNA, 19 nt, artificial
  Chemically synthesized
ugugagcauguguuaauca

SEQ ID NO: 8267 - RNA, 19 nt, artificial
  Chemically synthesized
aaaagaaguuguuguggcu

SEQ ID NO: 8268 - RNA, 19 nt, artificial
  Chemically synthesized
gauaagaccaggaagcgga

SEQ ID NO: 8269 - RNA, 19 nt, artificial
  Chemically synthesized
agacuguaaucaagaaccu

SEQ ID NO: 8270 - RNA, 19 nt, artificial
  Chemically synthesized
gauacauagggauaugugc

SEQ ID NO: 8271 - RNA, 19 nt, artificial
  Chemically synthesized
ugaacacccaguucaguca

SEQ ID NO: 8272 - RNA, 19 nt, artificial
  Chemically synthesized
acucaucucaaacagccau

SEQ ID NO: 8273 - RNA, 19 nt, artificial
  Chemically synthesized
uuccagacacauuguuuuc

SEQ ID NO: 8274 - RNA, 19 nt, artificial
  Chemically synthesized
uugaagcucagaucuaaau

SEQ ID NO: 8275 - RNA, 19 nt, artificial
  Chemically synthesized
acaaugucucuuucuguuu

SEQ ID NO: 8276 - RNA, 19 nt, artificial
  Chemically synthesized
uggcugggaucagaguccc

SEQ ID NO: 8277 - RNA, 19 nt, artificial
  Chemically synthesized
cuuauuaacugaacaagug

SEQ ID NO: 8278 - RNA, 19 nt, artificial
  Chemically synthesized
augguugugagcauguguu

SEQ ID NO: 8279 - RNA, 19 nt, artificial
  Chemically synthesized
uuaggcugguugucccaaa

SEQ ID NO: 8280 - RNA, 19 nt, artificial
  Chemically synthesized
cugcacuggaagcuccuug

SEQ ID NO: 8281 - RNA, 19 nt, artificial
  Chemically synthesized
gugauauucaaacucagca

SEQ ID NO: 8282 - RNA, 19 nt, artificial
  Chemically synthesized
cuuuguuggaagugaaagu

SEQ ID NO: 8283 - RNA, 19 nt, artificial
  Chemically synthesized
gugauugagacuguaauca

SEQ ID NO: 8284 - RNA, 19 nt, artificial
  Chemically synthesized
aagaagaaaacgccugcag

SEQ ID NO: 8285 - RNA, 19 nt, artificial
  Chemically synthesized
cuggaaagaauugccagcc

SEQ ID NO: 8286 - RNA, 19 nt, artificial
  Chemically synthesized
acuuuuccauacuuccuug

SEQ ID NO: 8287 - RNA, 19 nt, artificial
  Chemically synthesized
acccuuagcauaaggccug

SEQ ID NO: 8288 - RNA, 19 nt, artificial
  Chemically synthesized
aucuuguugcuggaaaggu

SEQ ID NO: 8289 - RNA, 19 nt, artificial
  Chemically synthesized
uggcuuaggcucugauaug

SEQ ID NO: 8290 - RNA, 19 nt, artificial
  Chemically synthesized
aaaauagaacaugcucgag

SEQ ID NO: 8291 - RNA, 19 nt, artificial
  Chemically synthesized
uaugagaaaugucaaggua

SEQ ID NO: 8292 - RNA, 19 nt, artificial
  Chemically synthesized
aaaauguggucaaggagca

SEQ ID NO: 8293 - RNA, 19 nt, artificial
  Chemically synthesized
gucuccagaagaugugccg

SEQ ID NO: 8294 - RNA, 19 nt, artificial
  Chemically synthesized
guaauaacaccauugaagc

SEQ ID NO: 8295 - RNA, 19 nt, artificial
  Chemically synthesized
agguccaggaaggucaagu

SEQ ID NO: 8296 - RNA, 19 nt, artificial
  Chemically synthesized
guaacaaacacuucugacu

SEQ ID NO: 8297 - RNA, 19 nt, artificial
  Chemically synthesized
guaugcuaaucggaauucu

SEQ ID NO: 8298 - RNA, 19 nt, artificial
  Chemically synthesized
uaccugaagacuggagagu

SEQ ID NO: 8299 - RNA, 19 nt, artificial
  Chemically synthesized
agaaccuggagggaguuca

SEQ ID NO: 8300 - RNA, 19 nt, artificial
  Chemically synthesized
aacagauacuacaagcaca

SEQ ID NO: 8301 - RNA, 19 nt, artificial
  Chemically synthesized
uauucaacuugaugaggua

SEQ ID NO: 8302 - RNA, 19 nt, artificial
  Chemically synthesized
aucgagguaguagucuaag

SEQ ID NO: 8303 - RNA, 19 nt, artificial
  Chemically synthesized
ugcucaaaccaaacacacu

SEQ ID NO: 8304 - RNA, 19 nt, artificial
  Chemically synthesized
auccagcagggcuuuucug

SEQ ID NO: 8305 - RNA, 19 nt, artificial
  Chemically synthesized
auaugugcacaaaugcaca

SEQ ID NO: 8306 - RNA, 19 nt, artificial
  Chemically synthesized
gacacaccaaugauggucu

SEQ ID NO: 8307 - RNA, 19 nt, artificial
  Chemically synthesized
ugagaaggcgguacagcuc

SEQ ID NO: 8308 - RNA, 19 nt, artificial
  Chemically synthesized
ucagggacaggucuaaaga

SEQ ID NO: 8309 - RNA, 19 nt, artificial
  Chemically synthesized
cgauggacuucuaaaccag

SEQ ID NO: 8310 - RNA, 19 nt, artificial
  Chemically synthesized
augcuggaaauccagaugu

SEQ ID NO: 8311 - RNA, 19 nt, artificial
  Chemically synthesized
cuagaaacucaaggcuugg

SEQ ID NO: 8312 - RNA, 19 nt, Artificial Sequence
  Chemically synthesized
gagacuacuguacaagcac

SEQ ID NO: 8313 - RNA, 19 nt, artificial
  Chemically synthesized
uucucagcaggaacacuua

SEQ ID NO: 8314 - RNA, 19 nt, artificial
  Chemically synthesized
ccauugcugccaacaucau

SEQ ID NO: 8315 - RNA, 19 nt, artificial
  Chemically synthesized
guucuauuuucaccugaug

SEQ ID NO: 8316 - RNA, 19 nt, artificial
  Chemically synthesized
ugguucugggagaauuuag

SEQ ID NO: 8317 - RNA, 19 nt, artificial
  Chemically synthesized
cauccagagccgcuggugu

SEQ ID NO: 8318 - RNA, 19 nt, artificial
  Chemically synthesized
ccauuggacaucucaaaac

SEQ ID NO: 8319 - RNA, 19 nt, artificial
  Chemically synthesized
aaacuucuugggcuuagaa

SEQ ID NO: 8320 - RNA, 19 nt, artificial
  Chemically synthesized
augaugccuuuguuaucua

SEQ ID NO: 8321 - RNA, 19 nt, artificial
  Chemically synthesized
agcacuucauccagagccg

SEQ ID NO: 8322 - RNA, 19 nt, artificial
  Chemically synthesized
cucaaucucucuuuagacc

SEQ ID NO: 8323 - RNA, 19 nt, artificial
  Chemically synthesized
uauuuagaucugagcuuca

SEQ ID NO: 8324 - RNA, 19 nt, artificial
  Chemically synthesized
cuauuuucaccugaugcuu

SEQ ID NO: 8325 - RNA, 19 nt, artificial
  Chemically synthesized
auugcucagaccuggcagu

SEQ ID NO: 8326 - RNA, 19 nt, artificial
  Chemically synthesized
cgccuggcugggacucuga

SEQ ID NO: 8327 - RNA, 19 nt, artificial
  Chemically synthesized
acucaagccaggaugagga

SEQ ID NO: 8328 - RNA, 19 nt, artificial
  Chemically synthesized
auugaagaauuccgauuag

SEQ ID NO: 8329 - RNA, 19 nt, artificial
  Chemically synthesized
cuacagagacuuuauuccc

SEQ ID NO: 8330 - RNA, 19 nt, artificial
  Chemically synthesized
uugaguuucuagaucucag

SEQ ID NO: 8331 - RNA, 19 nt, artificial
  Chemically synthesized
cacuucauccagagccgcu

SEQ ID NO: 8332 - RNA, 19 nt, artificial
  Chemically synthesized
agagccgcugguguaucuu

SEQ ID NO: 8333 - RNA, 19 nt, artificial
  Chemically synthesized
agcucugccuucacuacag

SEQ ID NO: 8334 - RNA, 19 nt, artificial
  Chemically synthesized
cuuaauguggcucacaauc

SEQ ID NO: 8335 - RNA, 19 nt, artificial
  Chemically synthesized
acuacagagacuuuauucc

SEQ ID NO: 8336 - RNA, 19 nt, artificial
  Chemically synthesized
aaauggcuggcaauucuuu

SEQ ID NO: 8337 - RNA, 19 nt, artificial
  Chemically synthesized
uuaccaugaguucaaacuu

SEQ ID NO: 8338 - RNA, 19 nt, artificial
  Chemically synthesized
uccagagccgcugguguau

SEQ ID NO: 8339 - RNA, 19 nt, artificial
  Chemically synthesized
cagcucugccuucacuaca

SEQ ID NO: 8340 - RNA, 19 nt, artificial
  Chemically synthesized
ccuucucagcaggaacacu

SEQ ID NO: 8341 - RNA, 19 nt, artificial
  Chemically synthesized
uaccaugaguucaaacuuc

SEQ ID NO: 8342 - RNA, 19 nt, artificial
  Chemically synthesized
ucuaugaugccuuuguuau

SEQ ID NO: 8343 - RNA, 19 nt, artificial
  Chemically synthesized
gaugccuuuguuaucuacu

SEQ ID NO: 8344 - RNA, 19 nt, artificial
  Chemically synthesized
cuucauuguccugcagaag

SEQ ID NO: 8345 - RNA, 19 nt, artificial
  Chemically synthesized
caugaguucaaacuucuug

SEQ ID NO: 8346 - RNA, 19 nt, artificial
  Chemically synthesized
uuguccugcagaaggugga

SEQ ID NO: 8347 - RNA, 19 nt, artificial
  Chemically synthesized
uugaauaugagauugcuca

SEQ ID NO: 8348 - RNA, 19 nt, artificial
  Chemically synthesized
ccgccuucucagcaggaac

SEQ ID NO: 8349 - RNA, 19 nt, artificial
  Chemically synthesized
aaguucuauuuucaccuga

SEQ ID NO: 8350 - RNA, 19 nt, artificial
  Chemically synthesized
ugcaauuugaccauugaag

SEQ ID NO: 8351 - RNA, 19 nt, artificial
  Chemically synthesized
cauuguccugcagaaggug

SEQ ID NO: 8352 - RNA, 19 nt, artificial
  Chemically synthesized
aucucucuuuagaccuguc

SEQ ID NO: 8353 - RNA, 19 nt, artificial
  Chemically synthesized
uuguuaucuacucaagcca

SEQ ID NO: 8354 - RNA, 19 nt, artificial
  Chemically synthesized
caucuucauuguccugcag

SEQ ID NO: 8355 - RNA, 19 nt, artificial
  Chemically synthesized
uaucuacucaagccaggau

SEQ ID NO: 8356 - RNA, 19 nt, artificial
  Chemically synthesized
auuaccaugaguucaaacu

SEQ ID NO: 8357 - RNA, 19 nt, artificial
  Chemically synthesized
cccagcacuucauccagag

SEQ ID NO: 8358 - RNA, 19 nt, artificial
  Chemically synthesized
aucuucauuguccugcaga

SEQ ID NO: 8359 - RNA, 19 nt, artificial
  Chemically synthesized
uguuaucuacucaagccag

SEQ ID NO: 8360 - RNA, 19 nt, artificial
  Chemically synthesized
ucccagcacuucauccaga

SEQ ID NO: 8361 - RNA, 19 nt, artificial
  Chemically synthesized
ucaaucucucuuuagaccu

SEQ ID NO: 8362 - RNA, 19 nt, artificial
  Chemically synthesized
agauugcucagaccuggca

SEQ ID NO: 8363 - RNA, 19 nt, artificial
  Chemically synthesized
ugucccagcacuucaucca

SEQ ID NO: 8364 - RNA, 19 nt, artificial
  Chemically synthesized
uuaucuacucaagccagga

SEQ ID NO: 8365 - RNA, 19 nt, artificial
  Chemically synthesized
cuaugaugccuuuguuauc

SEQ ID NO: 8366 - RNA, 19 nt, artificial
  Chemically synthesized
gccaggaugaggacugggu

SEQ ID NO: 8367 - RNA, 19 nt, artificial
  Chemically synthesized
aaaauggcuggcaauucuu

SEQ ID NO: 8368 - RNA, 19 nt, artificial
  Chemically synthesized
guuaucuacucaagccagg

SEQ ID NO: 8369 - RNA, 19 nt, artificial
  Chemically synthesized
cuuuguuaucuacucaagc

SEQ ID NO: 8370 - RNA, 19 nt, artificial
  Chemically synthesized
ccagagccgcugguguauc

SEQ ID NO: 8371 - RNA, 19 nt, artificial
  Chemically synthesized
auaugagauugcucagacc

SEQ ID NO: 8372 - RNA, 19 nt, artificial
  Chemically synthesized
ugagauugcucagaccugg

SEQ ID NO: 8373 - RNA, 19 nt, artificial
  Chemically synthesized
aaucucucuuuagaccugu

SEQ ID NO: 8374 - RNA, 19 nt, artificial
  Chemically synthesized
augccuuuguuaucuacuc

SEQ ID NO: 8375 - RNA, 19 nt, artificial
  Chemically synthesized
ucuauuuucaccugaugcu

SEQ ID NO: 8376 - RNA, 19 nt, artificial
  Chemically synthesized
uuuagaucugagcuucaau

SEQ ID NO: 8377 - RNA, 19 nt, artificial
  Chemically synthesized
aucuacucaagccaggaug

SEQ ID NO: 8378 - RNA, 19 nt, artificial
  Chemically synthesized
uuaauguggcucacaaucu

SEQ ID NO: 8379 - RNA, 19 nt, artificial
  Chemically synthesized
gcgccuggcugggacucug

SEQ ID NO: 8380 - RNA, 19 nt, artificial
  Chemically synthesized
uucaaacuucuugggcuua

SEQ ID NO: 8381 - RNA, 19 nt, artificial
  Chemically synthesized
augagauugcucagaccug

SEQ ID NO: 8382 - RNA, 19 nt, artificial
  Chemically synthesized
auuuucaccugaugcuucu

SEQ ID NO: 8383 - RNA, 19 nt, artificial
  Chemically synthesized
ucugccuucacuacagaga

SEQ ID NO: 8384 - RNA, 19 nt, artificial
  Chemically synthesized
augaguucaaacuucuugg

SEQ ID NO: 8385 - RNA, 19 nt, artificial
  Chemically synthesized
ugaauaugagauugcucag

SEQ ID NO: 8386 - RNA, 19 nt, artificial
  Chemically synthesized
caagccaggaugaggacug

SEQ ID NO: 8387 - RNA, 19 nt, artificial
  Chemically synthesized
gugauuuugggacaaccag

SEQ ID NO: 8388 - RNA, 19 nt, artificial
  Chemically synthesized
ugaugccuuuguuaucuac

SEQ ID NO: 8389 - RNA, 19 nt, artificial
  Chemically synthesized
uaugagauugcucagaccu

SEQ ID NO: 8390 - RNA, 19 nt, artificial
  Chemically synthesized
gauuguuguggugucccag

SEQ ID NO: 8391 - RNA, 19 nt, artificial
  Chemically synthesized
gagauugcucagaccuggc

SEQ ID NO: 8392 - RNA, 19 nt, artificial
  Chemically synthesized
cuucauccagagccgcugg

SEQ ID NO: 8393 - RNA, 19 nt, artificial
  Chemically synthesized
ggugucccagcacuucauc

SEQ ID NO: 8394 - RNA, 19 nt, artificial
  Chemically synthesized
gucccagcacuucauccag

SEQ ID NO: 8395 - RNA, 19 nt, artificial
  Chemically synthesized
ccuggcugggacucugauc

SEQ ID NO: 8396 - RNA, 19 nt, artificial
  Chemically synthesized
cauugcugccaacaucauc

SEQ ID NO: 8397 - RNA, 19 nt, artificial
  Chemically synthesized
aacuucuugggcuuagaac

SEQ ID NO: 8398 - RNA, 19 nt, artificial
  Chemically synthesized
cgcgccuggcugggacucu

SEQ ID NO: 8399 - RNA, 19 nt, artificial
  Chemically synthesized
gauugcucagaccuggcag

SEQ ID NO: 8400 - RNA, 19 nt, artificial
  Chemically synthesized
acuucauccagagccgcug

SEQ ID NO: 8401 - RNA, 19 nt, artificial
  Chemically synthesized
ugauuuugggacaaccagc

SEQ ID NO: 8402 - RNA, 19 nt, artificial
  Chemically synthesized
uucagcucugccuucacua

SEQ ID NO: 8403 - RNA, 19 nt, artificial
  Chemically synthesized
uguccugcagaagguggag

SEQ ID NO: 8404 - RNA, 19 nt, artificial
  Chemically synthesized
uugcucagaccuggcaguu

SEQ ID NO: 8405 - RNA, 19 nt, artificial
  Chemically synthesized
aauaugagauugcucagac

SEQ ID NO: 8406 - RNA, 19 nt, artificial
  Chemically synthesized
caggaacacuuaccuggag

SEQ ID NO: 8407 - RNA, 19 nt, artificial
  Chemically synthesized
gcacuucauccagagccgc

SEQ ID NO: 8408 - RNA, 19 nt, artificial
  Chemically synthesized
ugcugccaacaucauccau

SEQ ID NO: 8409 - RNA, 19 nt, artificial
  Chemically synthesized
cucaagccaggaugaggac

SEQ ID NO: 8410 - RNA, 19 nt, artificial
  Chemically synthesized
aaagaauuuagaagaaggg

SEQ ID NO: 8411 - RNA, 19 nt, artificial
  Chemically synthesized
ucuuugaauaugagauugc

SEQ ID NO: 8412 - RNA, 19 nt, artificial
  Chemically synthesized
ugaguucaaacuucuuggg

SEQ ID NO: 8413 - RNA, 19 nt, artificial
  Chemically synthesized
cagcaggaacacuuaccug

SEQ ID NO: 8414 - RNA, 19 nt, artificial
  Chemically synthesized
uauuaccaugaguucaaac

SEQ ID NO: 8415 - RNA, 19 nt, artificial
  Chemically synthesized
uuuguuaucuacucaagcc

SEQ ID NO: 8416 - RNA, 19 nt, artificial
  Chemically synthesized
uaaguucuauuuucaccug

SEQ ID NO: 8417 - RNA, 19 nt, artificial
  Chemically synthesized
gccuucucagcaggaacac

SEQ ID NO: 8418 - RNA, 19 nt, artificial
  Chemically synthesized
agcaggaacacuuaccugg

SEQ ID NO: 8419 - RNA, 19 nt, artificial
  Chemically synthesized
cucagcaggaacacuuacc

SEQ ID NO: 8420 - RNA, 19 nt, artificial
  Chemically synthesized
cuacucaagccaggaugag

SEQ ID NO: 8421 - RNA, 19 nt, artificial
  Chemically synthesized
aauggcuggcaauucuuuc

SEQ ID NO: 8422 - RNA, 19 nt, artificial
  Chemically synthesized
ccagcacuucauccagagc

SEQ ID NO: 8423 - RNA, 19 nt, artificial
  Chemically synthesized
uucauuguccugcagaagg

SEQ ID NO: 8424 - RNA, 19 nt, artificial
  Chemically synthesized
cucugccuucacuacagag

SEQ ID NO: 8425 - RNA, 19 nt, artificial
  Chemically synthesized
ucagcaggaacacuuaccu

SEQ ID NO: 8426 - RNA, 19 nt, artificial
  Chemically synthesized
uaugaugccuuuguuaucu

SEQ ID NO: 8427 - RNA, 19 nt, artificial
  Chemically synthesized
ucaaacuucuugggcuuag

SEQ ID NO: 8428 - RNA, 19 nt, artificial
  Chemically synthesized
aacuuuauccaaccaggug

SEQ ID NO: 8429 - RNA, 19 nt, artificial
  Chemically synthesized
auggcuggcaauucuuucc

SEQ ID NO: 8430 - RNA, 19 nt, artificial
  Chemically synthesized
auuguccugcagaaggugg

SEQ ID NO: 8431 - RNA, 19 nt, artificial
  Chemically synthesized
cagcacuucauccagagcc

SEQ ID NO: 8432 - RNA, 19 nt, artificial
  Chemically synthesized
uaucaucuucauuguccug

SEQ ID NO: 8433 - RNA, 19 nt, artificial
  Chemically synthesized
uacagcauuuuccaaguag

SEQ ID NO: 8434 - RNA, 19 nt, artificial
  Chemically synthesized
gugucccagcacuucaucc

SEQ ID NO: 8435 - RNA, 19 nt, artificial
  Chemically synthesized
uacucaagccaggaugagg

SEQ ID NO: 8436 - RNA, 19 nt, artificial
  Chemically synthesized
cuggcugggacucugaucc

SEQ ID NO: 8437 - RNA, 19 nt, artificial
  Chemically synthesized
ucagcucugccuucacuac

SEQ ID NO: 8438 - RNA, 19 nt, artificial
  Chemically synthesized
uuuucaccugaugcuucuu

SEQ ID NO: 8439 - RNA, 19 nt, artificial
  Chemically synthesized
gaguucaaacuucuugggc

SEQ ID NO: 8440 - RNA, 19 nt, artificial
  Chemically synthesized
uugcugccaacaucaucca

SEQ ID NO: 8441 - RNA, 19 nt, artificial
  Chemically synthesized
uauuuucaccugaugcuuc

SEQ ID NO: 8442 - RNA, 19 nt, artificial
  Chemically synthesized
uuucagcucugccuucacu

SEQ ID NO: 8443 - RNA, 19 nt, artificial
  Chemically synthesized
uuagaucugagcuucaaug

SEQ ID NO: 8444 - RNA, 19 nt, artificial
  Chemically synthesized
ucaagccaggaugaggacu

SEQ ID NO: 8445 - RNA, 19 nt, artificial
  Chemically synthesized
uuugaauaugagauugcuc

SEQ ID NO: 8446 - RNA, 19 nt, artificial
  Chemically synthesized
ucucagcaggaacacuuac

SEQ ID NO: 8447 - RNA, 19 nt, artificial
  Chemically synthesized
aagccaggaugaggacugg

SEQ ID NO: 8448 - RNA, 19 nt, artificial
  Chemically synthesized
auuucagcucugccuucac

SEQ ID NO: 8449 - RNA, 19 nt, artificial
  Chemically synthesized
ucccagccauggccuuccu

SEQ ID NO: 8450 - RNA, 19 nt, artificial
  Chemically synthesized
uucuauuuucaccugaugc

SEQ ID NO: 8451 - RNA, 19 nt, artificial
  Chemically synthesized
ucauccagagccgcuggug

SEQ ID NO: 8452 - RNA, 19 nt, artificial
  Chemically synthesized
auugcugccaacaucaucc

SEQ ID NO: 8453 - RNA, 19 nt, artificial
  Chemically synthesized
agccaggaugaggacuggg

SEQ ID NO: 8454 - RNA, 19 nt, artificial
  Chemically synthesized
uucauccagagccgcuggu

SEQ ID NO: 8455 - RNA, 19 nt, artificial
  Chemically synthesized
ucucucuuuagaccugucc

SEQ ID NO: 8456 - RNA, 19 nt, artificial
  Chemically synthesized
uagaucugagcuucaaugg

SEQ ID NO: 8457 - RNA, 19 nt, artificial
  Chemically synthesized
cccagccauggccuuccuc

SEQ ID NO: 8458 - RNA, 19 nt, artificial
  Chemically synthesized
aucccagccauggccuucc

SEQ ID NO: 8459 - RNA, 19 nt, artificial
  Chemically synthesized
uaaguguuccugcugagaa

SEQ ID NO: 8460 - RNA, 19 nt, artificial
  Chemically synthesized
augauguuggcagcaaugg

SEQ ID NO: 8461 - RNA, 19 nt, artificial
  Chemically synthesized
caucaggugaaaauagaac

SEQ ID NO: 8462 - RNA, 19 nt, artificial
  Chemically synthesized
cuaaauucucccagaacca

SEQ ID NO: 8463 - RNA, 19 nt, artificial
  Chemically synthesized
acaccagcggcucuggaug

SEQ ID NO: 8464 - RNA, 19 nt, artificial
  Chemically synthesized
guuuugagauguccaaugg

SEQ ID NO: 8465 - RNA, 19 nt, artificial
  Chemically synthesized
uucuaagcccaagaaguuu

SEQ ID NO: 8466 - RNA, 19 nt, artificial
  Chemically synthesized
uagauaacaaaggcaucau

SEQ ID NO: 8467 - RNA, 19 nt, artificial
  Chemically synthesized
cggcucuggaugaagugcu

SEQ ID NO: 8468 - RNA, 19 nt, artificial
  Chemically synthesized
ggucuaaagagagauugag

SEQ ID NO: 8469 - RNA, 19 nt, artificial
  Chemically synthesized
ugaagcucagaucuaaaua

SEQ ID NO: 8470 - RNA, 19 nt, artificial
  Chemically synthesized
aagcaucaggugaaaauag

SEQ ID NO: 8471 - RNA, 19 nt, artificial
  Chemically synthesized
acugccaggucugagcaau

SEQ ID NO: 8472 - RNA, 19 nt, artificial
  Chemically synthesized
ucagagucccagccaggcg

SEQ ID NO: 8473 - RNA, 19 nt, artificial
  Chemically synthesized
uccucauccuggcuugagu

SEQ ID NO: 8474 - RNA, 19 nt, artificial
  Chemically synthesized
cuaaucggaauucuucaau

SEQ ID NO: 8475 - RNA, 19 nt, artificial
  Chemically synthesized
gggaauaaagucucuguag

SEQ ID NO: 8476 - RNA, 19 nt, artificial
  Chemically synthesized
cugagaucuagaaacucaa

SEQ ID NO: 8477 - RNA, 19 nt, artificial
  Chemically synthesized
agcggcucuggaugaagug

SEQ ID NO: 8478 - RNA, 19 nt, artificial
  Chemically synthesized
aagauacaccagcggcucu

SEQ ID NO: 8479 - RNA, 19 nt, artificial
  Chemically synthesized
cuguagugaaggcagagcu

SEQ ID NO: 8480 - RNA, 19 nt, artificial
  Chemically synthesized
gauugugagccacauuaag

SEQ ID NO: 8481 - RNA, 19 nt, artificial
  Chemically synthesized
ggaauaaagucucuguagu

SEQ ID NO: 8482 - RNA, 19 nt, artificial
  Chemically synthesized
aaagaauugccagccauuu

SEQ ID NO: 8483 - RNA, 19 nt, artificial
  Chemically synthesized
aaguuugaacucaugguaa

SEQ ID NO: 8484 - RNA, 19 nt, artificial
  Chemically synthesized
auacaccagcggcucugga

SEQ ID NO: 8485 - RNA, 19 nt, artificial
  Chemically synthesized
uguagugaaggcagagcug

SEQ ID NO: 8486 - RNA, 19 nt, artificial
  Chemically synthesized
aguguuccugcugagaagg

SEQ ID NO: 8487 - RNA, 19 nt, artificial
  Chemically synthesized
gaaguuugaacucauggua

SEQ ID NO: 8488 - RNA, 19 nt, artificial
  Chemically synthesized
auaacaaaggcaucauaga

SEQ ID NO: 8489 - RNA, 19 nt, artificial
  Chemically synthesized
aguagauaacaaaggcauc

SEQ ID NO: 8490 - RNA, 19 nt, artificial
  Chemically synthesized
cuucugcaggacaaugaag

SEQ ID NO: 8491 - RNA, 19 nt, artificial
  Chemically synthesized
caagaaguuugaacucaug

SEQ ID NO: 8492 - RNA, 19 nt, artificial
  Chemically synthesized
uccaccuucugcaggacaa

SEQ ID NO: 8493 - RNA, 19 nt, artificial
  Chemically synthesized
ugagcaaucucauauucaa

SEQ ID NO: 8494 - RNA, 19 nt, artificial
  Chemically synthesized
guuccugcugagaaggcgg

SEQ ID NO: 8495 - RNA, 19 nt, artificial
  Chemically synthesized
ucaggugaaaauagaacuu

SEQ ID NO: 8496 - RNA, 19 nt, artificial
  Chemically synthesized
cuucaauggucaaauugca

SEQ ID NO: 8497 - RNA, 19 nt, artificial
  Chemically synthesized
caccuucugcaggacaaug

SEQ ID NO: 8498 - RNA, 19 nt, artificial
  Chemically synthesized
gacaggucuaaagagagau

SEQ ID NO: 8499 - RNA, 19 nt, artificial
  Chemically synthesized
uggcuugaguagauaacaa

SEQ ID NO: 8500 - RNA, 19 nt, artificial
  Chemically synthesized
cugcaggacaaugaagaug

SEQ ID NO: 8501 - RNA, 19 nt, artificial
  Chemically synthesized
auccuggcuugaguagaua

SEQ ID NO: 8502 - RNA, 19 nt, artificial
  Chemically synthesized
aguuugaacucaugguaau

SEQ ID NO: 8503 - RNA, 19 nt, artificial
  Chemically synthesized
cucuggaugaagugcuggg

SEQ ID NO: 8504 - RNA, 19 nt, artificial
  Chemically synthesized
ucugcaggacaaugaagau

SEQ ID NO: 8505 - RNA, 19 nt, artificial
  Chemically synthesized
cuggcuugaguagauaaca

SEQ ID NO: 8506 - RNA, 19 nt, artificial
  Chemically synthesized
ucuggaugaagugcuggga

SEQ ID NO: 8507 - RNA, 19 nt, artificial
  Chemically synthesized
aggucuaaagagagauuga

SEQ ID NO: 8508 - RNA, 19 nt, artificial
  Chemically synthesized
ugccaggucugagcaaucu

SEQ ID NO: 8509 - RNA, 19 nt, artificial
  Chemically synthesized
uggaugaagugcugggaca

SEQ ID NO: 8510 - RNA, 19 nt, artificial
  Chemically synthesized
uccuggcuugaguagauaa

SEQ ID NO: 8511 - RNA, 19 nt, artificial
  Chemically synthesized
gauaacaaaggcaucauag

SEQ ID NO: 8512 - RNA, 19 nt, artificial
  Chemically synthesized
acccaguccucauccuggc

SEQ ID NO: 8513 - RNA, 19 nt, artificial
  Chemically synthesized
aagaauugccagccauuuu

SEQ ID NO: 8514 - RNA, 19 nt, artificial
  Chemically synthesized
ccuggcuugaguagauaac

SEQ ID NO: 8515 - RNA, 19 nt, artificial
  Chemically synthesized
gcuugaguagauaacaaag

SEQ ID NO: 8516 - RNA, 19 nt, artificial
  Chemically synthesized
gauacaccagcggcucugg

SEQ ID NO: 8517 - RNA, 19 nt, artificial
  Chemically synthesized
ggucugagcaaucucauau

SEQ ID NO: 8518 - RNA, 19 nt, artificial
  Chemically synthesized
ccaggucugagcaaucuca

SEQ ID NO: 8519 - RNA, 19 nt, artificial
  Chemically synthesized
acaggucuaaagagagauu

SEQ ID NO: 8520 - RNA, 19 nt, artificial
  Chemically synthesized
gaguagauaacaaaggcau

SEQ ID NO: 8521 - RNA, 19 nt, artificial
  Chemically synthesized
agcaucaggugaaaauaga

SEQ ID NO: 8522 - RNA, 19 nt, artificial
  Chemically synthesized
auugaagcucagaucuaaa

SEQ ID NO: 8523 - RNA, 19 nt, artificial
  Chemically synthesized
cauccuggcuugaguagau

SEQ ID NO: 8524 - RNA, 19 nt, artificial
  Chemically synthesized
agauugugagccacauuaa

SEQ ID NO: 8525 - RNA, 19 nt, artificial
  Chemically synthesized
cagagucccagccaggcgc

SEQ ID NO: 8526 - RNA, 19 nt, artificial
  Chemically synthesized
uaagcccaagaaguuugaa

SEQ ID NO: 8527 - RNA, 19 nt, artificial
  Chemically synthesized
caggucugagcaaucucau

SEQ ID NO: 8528 - RNA, 19 nt, artificial
  Chemically synthesized
agaagcaucaggugaaaau

SEQ ID NO: 8529 - RNA, 19 nt, artificial
  Chemically synthesized
ucucuguagugaaggcaga

SEQ ID NO: 8530 - RNA, 19 nt, artificial
  Chemically synthesized
ccaagaaguuugaacucau

SEQ ID NO: 8531 - RNA, 19 nt, artificial
  Chemically synthesized
cugagcaaucucauauuca

SEQ ID NO: 8532 - RNA, 19 nt, artificial
  Chemically synthesized
caguccucauccuggcuug

SEQ ID NO: 8533 - RNA, 19 nt, artificial
  Chemically synthesized
cugguugucccaaaaucac

SEQ ID NO: 8534 - RNA, 19 nt, artificial
  Chemically synthesized
guagauaacaaaggcauca

SEQ ID NO: 8535 - RNA, 19 nt, artificial
  Chemically synthesized
aggucugagcaaucucaua

SEQ ID NO: 8536 - RNA, 19 nt, artificial
  Chemically synthesized
cugggacaccacaacaauc

SEQ ID NO: 8537 - RNA, 19 nt, artificial
  Chemically synthesized
gccaggucugagcaaucuc

SEQ ID NO: 8538 - RNA, 19 nt, artificial
  Chemically synthesized
ccagcggcucuggaugaag

SEQ ID NO: 8539 - RNA, 19 nt, artificial
  Chemically synthesized
gaugaagugcugggacacc

SEQ ID NO: 8540 - RNA, 19 nt, artificial
  Chemically synthesized
cuggaugaagugcugggac

SEQ ID NO: 8541 - RNA, 19 nt, artificial
  Chemically synthesized
gaucagagucccagccagg

SEQ ID NO: 8542 - RNA, 19 nt, artificial
  Chemically synthesized
gaugauguuggcagcaaug

SEQ ID NO: 8543 - RNA, 19 nt, artificial
  Chemically synthesized
guucuaagcccaagaaguu

SEQ ID NO: 8544 - RNA, 19 nt, artificial
  Chemically synthesized
agagucccagccaggcgcg

SEQ ID NO: 8545 - RNA, 19 nt, artificial
  Chemically synthesized
cugccaggucugagcaauc

SEQ ID NO: 8546 - RNA, 19 nt, artificial
  Chemically synthesized
cagcggcucuggaugaagu

SEQ ID NO: 8547 - RNA, 19 nt, artificial
  Chemically synthesized
gcugguugucccaaaauca

SEQ ID NO: 8548 - RNA, 19 nt, artificial
  Chemically synthesized
uagugaaggcagagcugaa

SEQ ID NO: 8549 - RNA, 19 nt, artificial
  Chemically synthesized
cuccaccuucugcaggaca

SEQ ID NO: 8550 - RNA, 19 nt, artificial
  Chemically synthesized
aacugccaggucugagcaa

SEQ ID NO: 8551 - RNA, 19 nt, artificial
  Chemically synthesized
gucugagcaaucucauauu

SEQ ID NO: 8552 - RNA, 19 nt, artificial
  Chemically synthesized
cuccagguaaguguuccug

SEQ ID NO: 8553 - RNA, 19 nt, artificial
  Chemically synthesized
gcggcucuggaugaagugc

SEQ ID NO: 8554 - RNA, 19 nt, artificial
  Chemically synthesized
auggaugauguuggcagca

SEQ ID NO: 8555 - RNA, 19 nt, artificial
  Chemically synthesized
guccucauccuggcuugag

SEQ ID NO: 8556 - RNA, 19 nt, artificial
  Chemically synthesized
cccuucuucuaaauucuuu

SEQ ID NO: 8557 - RNA, 19 nt, artificial
  Chemically synthesized
gcaaucucauauucaaaga

SEQ ID NO: 8558 - RNA, 19 nt, artificial
  Chemically synthesized
cccaagaaguuugaacuca

SEQ ID NO: 8559 - RNA, 19 nt, artificial
  Chemically synthesized
cagguaaguguuccugcug

SEQ ID NO: 8560 - RNA, 19 nt, artificial
  Chemically synthesized
guuugaacucaugguaaua

SEQ ID NO: 8561 - RNA, 19 nt, artificial
  Chemically synthesized
ggcuugaguagauaacaaa

SEQ ID NO: 8562 - RNA, 19 nt, artificial
  Chemically synthesized
caggugaaaauagaacuua

SEQ ID NO: 8563 - RNA, 19 nt, artificial
  Chemically synthesized
guguuccugcugagaaggc

SEQ ID NO: 8564 - RNA, 19 nt, artificial
  Chemically synthesized
ccagguaaguguuccugcu

SEQ ID NO: 8565 - RNA, 19 nt, artificial
  Chemically synthesized
gguaaguguuccugcugag

SEQ ID NO: 8566 - RNA, 19 nt, artificial
  Chemically synthesized
cucauccuggcuugaguag

SEQ ID NO: 8567 - RNA, 19 nt, artificial
  Chemically synthesized
gaaagaauugccagccauu

SEQ ID NO: 8568 - RNA, 19 nt, artificial
  Chemically synthesized
gcucuggaugaagugcugg

SEQ ID NO: 8569 - RNA, 19 nt, artificial
  Chemically synthesized
ccuucugcaggacaaugaa

SEQ ID NO: 8570 - RNA, 19 nt, artificial
  Chemically synthesized
cucuguagugaaggcagag

SEQ ID NO: 8571 - RNA, 19 nt, artificial
  Chemically synthesized
agguaaguguuccugcuga

SEQ ID NO: 8572 - RNA, 19 nt, artificial
  Chemically synthesized
agauaacaaaggcaucaua

SEQ ID NO: 8573 - RNA, 19 nt, artificial
  Chemically synthesized
cuaagcccaagaaguuuga

SEQ ID NO: 8574 - RNA, 19 nt, artificial
  Chemically synthesized
caccugguuggauaaaguu

SEQ ID NO: 8575 - RNA, 19 nt, artificial
  Chemically synthesized
ggaaagaauugccagccau

SEQ ID NO: 8576 - RNA, 19 nt, artificial
  Chemically synthesized
ccaccuucugcaggacaau

SEQ ID NO: 8577 - RNA, 19 nt, artificial
  Chemically synthesized
ggcucuggaugaagugcug

SEQ ID NO: 8578 - RNA, 19 nt, artificial
  Chemically synthesized
caggacaaugaagaugaua

SEQ ID NO: 8579 - RNA, 19 nt, artificial
  Chemically synthesized
cuacuuggaaaaugcugua

SEQ ID NO: 8580 - RNA, 19 nt, artificial
  Chemically synthesized
ggaugaagugcugggacac

SEQ ID NO: 8581 - RNA, 19 nt, artificial
  Chemically synthesized
ccucauccuggcuugagua

SEQ ID NO: 8582 - RNA, 19 nt, artificial
  Chemically synthesized
ggaucagagucccagccag

SEQ ID NO: 8583 - RNA, 19 nt, artificial
  Chemically synthesized
guagugaaggcagagcuga

SEQ ID NO: 8584 - RNA, 19 nt, artificial
  Chemically synthesized
aagaagcaucaggugaaaa

SEQ ID NO: 8585 - RNA, 19 nt, artificial
  Chemically synthesized
gcccaagaaguuugaacuc

SEQ ID NO: 8586 - RNA, 19 nt, artificial
  Chemically synthesized
uggaugauguuggcagcaa

SEQ ID NO: 8587 - RNA, 19 nt, artificial
  Chemically synthesized
gaagcaucaggugaaaaua

SEQ ID NO: 8588 - RNA, 19 nt, artificial
  Chemically synthesized
agugaaggcagagcugaaa

SEQ ID NO: 8589 - RNA, 19 nt, artificial
  Chemically synthesized
cauugaagcucagaucuaa

SEQ ID NO: 8590 - RNA, 19 nt, artificial
  Chemically synthesized
aguccucauccuggcuuga

SEQ ID NO: 8591 - RNA, 19 nt, artificial
  Chemically synthesized
gagcaaucucauauucaaa

SEQ ID NO: 8592 - RNA, 19 nt, artificial
  Chemically synthesized
guaaguguuccugcugaga

SEQ ID NO: 8593 - RNA, 19 nt, artificial
  Chemically synthesized
ccaguccucauccuggcuu

SEQ ID NO: 8594 - RNA, 19 nt, artificial
  Chemically synthesized
gugaaggcagagcugaaau

SEQ ID NO: 8595 - RNA, 19 nt, artificial
  Chemically synthesized
aggaaggccauggcuggga

SEQ ID NO: 8596 - RNA, 19 nt, artificial
  Chemically synthesized
gcaucaggugaaaauagaa

SEQ ID NO: 8597 - RNA, 19 nt, artificial
  Chemically synthesized
caccagcggcucuggauga

SEQ ID NO: 8598 - RNA, 19 nt, artificial
  Chemically synthesized
ggaugauguuggcagcaau

SEQ ID NO: 8599 - RNA, 19 nt, artificial
  Chemically synthesized
cccaguccucauccuggcu

SEQ ID NO: 8600 - RNA, 19 nt, artificial
  Chemically synthesized
accagcggcucuggaugaa

SEQ ID NO: 8601 - RNA, 19 nt, artificial
  Chemically synthesized
ggacaggucuaaagagaga

SEQ ID NO: 8602 - RNA, 19 nt, artificial
  Chemically synthesized
ccauugaagcucagaucua

SEQ ID NO: 8603 - RNA, 19 nt, artificial
  Chemically synthesized
gaggaaggccauggcuggg

SEQ ID NO: 8604 - RNA, 19 nt, Artificial Sequence
  Chemically synthesized
ggaaggccauggcugggau

SEQ ID NO: 8605 - RNA, 18 nt, artificial
  Chemically synthesized
gguucuugauuacagucu

SEQ ID NO: 8606 - RNA, 18 nt, artificial
  Chemically synthesized
ggaguugucuaauuggua

SEQ ID NO: 8607 - RNA, 18 nt, artificial
  Chemically synthesized
ggguguguuuccaugucu

SEQ ID NO: 8608 - RNA, 18 nt, artificial
  Chemically synthesized
ggcuugaguuucaaaggu

SEQ ID NO: 8609 - RNA, 18 nt, artificial
  Chemically synthesized
gucuauggcuguuugaga

SEQ ID NO: 8610 - RNA, 18 nt, artificial
  Chemically synthesized
ggcuguguguauuugaaa

SEQ ID NO: 8611 - RNA, 18 nt, artificial
  Chemically synthesized
ggcuaauuccuaaggaaa

SEQ ID NO: 8612 - RNA, 18 nt, artificial
  Chemically synthesized
gguggaaguugaacgaau

SEQ ID NO: 8613 - RNA, 18 nt, artificial
  Chemically synthesized
gcaacaagauucaaagua

SEQ ID NO: 8614 - RNA, 18 nt, artificial
  Chemically synthesized
gucuuaucauggacaauu

SEQ ID NO: 8615 - RNA, 18 nt, artificial
  Chemically synthesized
gcggguucuacaucaaau

SEQ ID NO: 8616 - RNA, 18 nt, artificial
  Chemically synthesized
ggaagagaagacaccagu

SEQ ID NO: 8617 - RNA, 18 nt, artificial
  Chemically synthesized
gcuugaguuucaaagguu

SEQ ID NO: 8618 - RNA, 18 nt, artificial
  Chemically synthesized
ggagacaaaucuagcauc

SEQ ID NO: 8619 - RNA, 18 nt, artificial
  Chemically synthesized
ggcuguuugagaugaguu

SEQ ID NO: 8620 - RNA, 18 nt, artificial
  Chemically synthesized
gaguauacauugcuguuu

SEQ ID NO: 8621 - RNA, 18 nt, artificial
  Chemically synthesized
ggugugaaauccagacaa

SEQ ID NO: 8622 - RNA, 18 nt, artificial
  Chemically synthesized
ggaggaagggagaaauga

SEQ ID NO: 8623 - RNA, 18 nt, artificial
  Chemically synthesized
ggaugucuauggcuguuu

SEQ ID NO: 8624 - RNA, 18 nt, artificial
  Chemically synthesized
gcucagaccuggcaguuu

SEQ ID NO: 8625 - RNA, 18 nt, artificial
  Chemically synthesized
ggugggcauuucaaccaa

SEQ ID NO: 8626 - RNA, 18 nt, artificial
  Chemically synthesized
gagugaguuuucaguauu

SEQ ID NO: 8627 - RNA, 18 nt, artificial
  Chemically synthesized
gaugaguucucuacucuu

SEQ ID NO: 8628 - RNA, 18 nt, artificial
  Chemically synthesized
ggugaaaacaucuaugau

SEQ ID NO: 8629 - RNA, 18 nt, artificial
  Chemically synthesized
gccuugaguuucuagauc

SEQ ID NO: 8630 - RNA, 18 nt, artificial
  Chemically synthesized
ggcauuucaaccaacuca

SEQ ID NO: 8631 - RNA, 18 nt, artificial
  Chemically synthesized
gcuguggagacaaaucua

SEQ ID NO: 8632 - RNA, 18 nt, artificial
  Chemically synthesized
gcaacaucuaucugaaga

SEQ ID NO: 8633 - RNA, 18 nt, artificial
  Chemically synthesized
caguauuccuaucacuca

SEQ ID NO: 8634 - RNA, 18 nt, artificial
  Chemically synthesized
agaguuuccugcaaugga

SEQ ID NO: 8635 - RNA, 18 nt, artificial
  Chemically synthesized
ugacaaaucugcucuaga

SEQ ID NO: 8636 - RNA, 18 nt, artificial
  Chemically synthesized
ccuugaguuucuagaucu

SEQ ID NO: 8637 - RNA, 18 nt, artificial
  Chemically synthesized
ggcguuuucuucuucuaa

SEQ ID NO: 8638 - RNA, 18 nt, artificial
  Chemically synthesized
gccuaagccaccucucua

SEQ ID NO: 8639 - RNA, 18 nt, artificial
  Chemically synthesized
gccuuaugcuaaggguga

SEQ ID NO: 8640 - RNA, 18 nt, artificial
  Chemically synthesized
ugcagaagguggagaaga

SEQ ID NO: 8641 - RNA, 18 nt, artificial
  Chemically synthesized
ccuucacuacagagacuu

SEQ ID NO: 8642 - RNA, 18 nt, artificial
  Chemically synthesized
ccuuuguuaucuacucaa

SEQ ID NO: 8643 - RNA, 18 nt, artificial
  Chemically synthesized
gggagaaaugaggaaaua

SEQ ID NO: 8644 - RNA, 18 nt, artificial
  Chemically synthesized
guggcuguggagacaaau

SEQ ID NO: 8645 - RNA, 18 nt, artificial
  Chemically synthesized
cagucucaaucacauaau

SEQ ID NO: 8646 - RNA, 18 nt, artificial
  Chemically synthesized
gguggcuguggagacaaa

SEQ ID NO: 8647 - RNA, 18 nt, artificial
  Chemically synthesized
ggaagaaaauuuccgcuu

SEQ ID NO: 8648 - RNA, 18 nt, artificial
  Chemically synthesized
gggaguauacauugcugu

SEQ ID NO: 8649 - RNA, 18 nt, artificial
  Chemically synthesized
gaagagagugugauuaua

SEQ ID NO: 8650 - RNA, 18 nt, artificial
  Chemically synthesized
cacuacagagacuuuauu

SEQ ID NO: 8651 - RNA, 18 nt, artificial
  Chemically synthesized
cgagcauguucuauuuuu

SEQ ID NO: 8652 - RNA, 18 nt, artificial
  Chemically synthesized
gcaucucuagagaacuuc

SEQ ID NO: 8653 - RNA, 18 nt, artificial
  Chemically synthesized
cucacaaucuuauccaau

SEQ ID NO: 8654 - RNA, 18 nt, artificial
  Chemically synthesized
ggagaaaugaggaaauag

SEQ ID NO: 8655 - RNA, 18 nt, artificial
  Chemically synthesized
agacuugcggguucuaca

SEQ ID NO: 8656 - RNA, 18 nt, artificial
  Chemically synthesized
cuguuugagaugaguucu

SEQ ID NO: 8657 - RNA, 18 nt, artificial
  Chemically synthesized
gcaggaagcaacaucuau

SEQ ID NO: 8658 - RNA, 18 nt, artificial
  Chemically synthesized
gcguuuucuucuucuaac

SEQ ID NO: 8659 - RNA, 18 nt, artificial
  Chemically synthesized
ucuagaucucaguagaaa

SEQ ID NO: 8660 - RNA, 18 nt, artificial
  Chemically synthesized
ggcuccugaugcaagaug

SEQ ID NO: 8661 - RNA, 18 nt, artificial
  Chemically synthesized
ggaccuuuccagcaacaa

SEQ ID NO: 8662 - RNA, 18 nt, artificial
  Chemically synthesized
ccugcgugagaccagaaa

SEQ ID NO: 8663 - RNA, 18 nt, artificial
  Chemically synthesized
caccagaguugcuuucaa

SEQ ID NO: 8664 - RNA, 18 nt, artificial
  Chemically synthesized
ugcggguucuacaucaaa

SEQ ID NO: 8665 - RNA, 18 nt, artificial
  Chemically synthesized
gauguuugauggaccucu

SEQ ID NO: 8666 - RNA, 18 nt, artificial
  Chemically synthesized
gaguuuucaguauuccua

SEQ ID NO: 8667 - RNA, 18 nt, artificial
  Chemically synthesized
gcuuccuggucuuaucau

SEQ ID NO: 8668 - RNA, 18 nt, artificial
  Chemically synthesized
ggugaguaauuccauggu

SEQ ID NO: 8669 - RNA, 18 nt, artificial
  Chemically synthesized
ugaccaaucuagagcacu

SEQ ID NO: 8670 - RNA, 18 nt, artificial
  Chemically synthesized
gagucuuccaggugggca

SEQ ID NO: 8671 - RNA, 18 nt, artificial
  Chemically synthesized
ggucuuaucauggacaau

SEQ ID NO: 8672 - RNA, 18 nt, artificial
  Chemically synthesized
caucauccaugaagguuu

SEQ ID NO: 8673 - RNA, 18 nt, artificial
  Chemically synthesized
agacaaaucuagcaucuc

SEQ ID NO: 8674 - RNA, 18 nt, artificial
  Chemically synthesized
cuucuaacuuccucuccu

SEQ ID NO: 8675 - RNA, 18 nt, artificial
  Chemically synthesized
cucucaaaaggcuuacuu

SEQ ID NO: 8676 - RNA, 18 nt, artificial
  Chemically synthesized
ccuccagguucuugauua

SEQ ID NO: 8677 - RNA, 18 nt, artificial
  Chemically synthesized
ggcaggaagcaacaucua

SEQ ID NO: 8678 - RNA, 18 nt, artificial
  Chemically synthesized
ggcaacauuuagaauuag

SEQ ID NO: 8679 - RNA, 18 nt, artificial
  Chemically synthesized
gguugcuguucucaaagu

SEQ ID NO: 8680 - RNA, 18 nt, artificial
  Chemically synthesized
uggagacaaaucuagcau

SEQ ID NO: 8681 - RNA, 18 nt, artificial
  Chemically synthesized
guuugguucugggagaau

SEQ ID NO: 8682 - RNA, 18 nt, artificial
  Chemically synthesized
gucucgaagucuugaaaa

SEQ ID NO: 8683 - RNA, 18 nt, artificial
  Chemically synthesized
augcuaagggugaguaau

SEQ ID NO: 8684 - RNA, 18 nt, artificial
  Chemically synthesized
agaacugcuuugaauaca

SEQ ID NO: 8685 - RNA, 18 nt, artificial
  Chemically synthesized
gcaguucuggucuauaag

SEQ ID NO: 8686 - RNA, 18 nt, artificial
  Chemically synthesized
ccucgaugauauuauuga

SEQ ID NO: 8687 - RNA, 18 nt, artificial
  Chemically synthesized
cugggagaauuuagaaau

SEQ ID NO: 8688 - RNA, 18 nt, artificial
  Chemically synthesized
gguaaaucauggaaucca

SEQ ID NO: 8689 - RNA, 18 nt, artificial
  Chemically synthesized
gagucuuuugaauggaaa

SEQ ID NO: 8690 - RNA, 18 nt, artificial
  Chemically synthesized
ugcuaagggugaguaauu

SEQ ID NO: 8691 - RNA, 18 nt, artificial
  Chemically synthesized
ggcagggaguauacauug

SEQ ID NO: 8692 - RNA, 18 nt, artificial
  Chemically synthesized
agacagagaaaacagaaa

SEQ ID NO: 8693 - RNA, 18 nt, artificial
  Chemically synthesized
cuaccaagccuugaguuu

SEQ ID NO: 8694 - RNA, 18 nt, artificial
  Chemically synthesized
agaaguugaucuaccaag

SEQ ID NO: 8695 - RNA, 18 nt, artificial
  Chemically synthesized
ugagaugaguucucuacu

SEQ ID NO: 8696 - RNA, 18 nt, artificial
  Chemically synthesized
gugcuuguacaguagucu

SEQ ID NO: 8697 - RNA, 18 nt, artificial
  Chemically synthesized
gguucuacaucaaaugcc

SEQ ID NO: 8698 - RNA, 18 nt, artificial
  Chemically synthesized
ggcugguuuagaagucca

SEQ ID NO: 8699 - RNA, 18 nt, artificial
  Chemically synthesized
ccaacucagucaaggaac

SEQ ID NO: 8700 - RNA, 18 nt, artificial
  Chemically synthesized
cagucuucagguacuaaa

SEQ ID NO: 8701 - RNA, 18 nt, artificial
  Chemically synthesized
ggcucgaggaagagaaga

SEQ ID NO: 8702 - RNA, 18 nt, artificial
  Chemically synthesized
caguucuggucuauaagu

SEQ ID NO: 8703 - RNA, 18 nt, artificial
  Chemically synthesized
ggauacguuuccuuauaa

SEQ ID NO: 8704 - RNA, 18 nt, artificial
  Chemically synthesized
gccgaaaggugauuguug

SEQ ID NO: 8705 - RNA, 18 nt, artificial
  Chemically synthesized
agccuugaguuucuagau

SEQ ID NO: 8706 - RNA, 18 nt, artificial
  Chemically synthesized
ccagaacugcuuugaaua

SEQ ID NO: 8707 - RNA, 18 nt, artificial
  Chemically synthesized
gaacuacgugugaaggua

SEQ ID NO: 8708 - RNA, 18 nt, artificial
  Chemically synthesized
gccuauaagcuaauauca

SEQ ID NO: 8709 - RNA, 18 nt, artificial
  Chemically synthesized
uguccagucucgaagucu

SEQ ID NO: 8710 - RNA, 18 nt, artificial
  Chemically synthesized
gcgugagaccagaaagcu

SEQ ID NO: 8711 - RNA, 18 nt, artificial
  Chemically synthesized
gcuaagggugaguaauuc

SEQ ID NO: 8712 - RNA, 18 nt, artificial
  Chemically synthesized
ccucucuaccuuaauauu

SEQ ID NO: 8713 - RNA, 18 nt, artificial
  Chemically synthesized
aguugaucuaccaagccu

SEQ ID NO: 8714 - RNA, 18 nt, artificial
  Chemically synthesized
ggauuuccagcauuccaa

SEQ ID NO: 8715 - RNA, 18 nt, artificial
  Chemically synthesized
gagacaaaucuagcaucu

SEQ ID NO: 8716 - RNA, 18 nt, artificial
  Chemically synthesized
aggucuagggugauugaa

SEQ ID NO: 8717 - RNA, 18 nt, artificial
  Chemically synthesized
ccaacagcauuuaacuca

SEQ ID NO: 8718 - RNA, 18 nt, artificial
  Chemically synthesized
cagaaguugaucuaccaa

SEQ ID NO: 8719 - RNA, 18 nt, artificial
  Chemically synthesized
ccagcaacaagauucaaa

SEQ ID NO: 8720 - RNA, 18 nt, artificial
  Chemically synthesized
gcccagaacugcuuugaa

SEQ ID NO: 8721 - RNA, 18 nt, artificial
  Chemically synthesized
gaguuuccugcaauggau

SEQ ID NO: 8722 - RNA, 18 nt, artificial
  Chemically synthesized
agaugaguucucuacucu

SEQ ID NO: 8723 - RNA, 18 nt, artificial
  Chemically synthesized
ccaugaguucaaacuucu

SEQ ID NO: 8724 - RNA, 18 nt, artificial
  Chemically synthesized
cuugauuccagaaacaua

SEQ ID NO: 8725 - RNA, 18 nt, artificial
  Chemically synthesized
ggcacaucuucuggagac

SEQ ID NO: 8726 - RNA, 18 nt, artificial
  Chemically synthesized
gaguguguuugguuugag

SEQ ID NO: 8727 - RNA, 18 nt, artificial
  Chemically synthesized
aguuucuagaucucagua

SEQ ID NO: 8728 - RNA, 18 nt, artificial
  Chemically synthesized
gucucaaucacauaauga

SEQ ID NO: 8729 - RNA, 18 nt, artificial
  Chemically synthesized
cuccugugacaaaagaga

SEQ ID NO: 8730 - RNA, 18 nt, artificial
  Chemically synthesized
cucagaaugacuuugcuu

SEQ ID NO: 8731 - RNA, 18 nt, artificial
  Chemically synthesized
agagaaaacagaaagaga

SEQ ID NO: 8732 - RNA, 18 nt, artificial
  Chemically synthesized
aguauuuauugcacagac

SEQ ID NO: 8733 - RNA, 18 nt, artificial
  Chemically synthesized
cugagaaacuugaccuuc

SEQ ID NO: 8734 - RNA, 18 nt, artificial
  Chemically synthesized
guuuguuacugaguguuu

SEQ ID NO: 8735 - RNA, 18 nt, artificial
  Chemically synthesized
gacuuugcuuguacuugu

SEQ ID NO: 8736 - RNA, 18 nt, artificial
  Chemically synthesized
cacagagcugagaaacuu

SEQ ID NO: 8737 - RNA, 18 nt, artificial
  Chemically synthesized
ccacuauuuuucaaggaa

SEQ ID NO: 8738 - RNA, 18 nt, artificial
  Chemically synthesized
agaguuuagcccugggag

SEQ ID NO: 8739 - RNA, 18 nt, artificial
  Chemically synthesized
agcugguggcuguggaga

SEQ ID NO: 8740 - RNA, 18 nt, artificial
  Chemically synthesized
gaugguaaaucauggaau

SEQ ID NO: 8741 - RNA, 18 nt, artificial
  Chemically synthesized
gggugauugaacaucccu

SEQ ID NO: 8742 - RNA, 18 nt, artificial
  Chemically synthesized
aggugauuguuguggugu

SEQ ID NO: 8743 - RNA, 18 nt, artificial
  Chemically synthesized
cagugugcuuguaguauc

SEQ ID NO: 8744 - RNA, 18 nt, artificial
  Chemically synthesized
ugaccuuccuggaccucu

SEQ ID NO: 8745 - RNA, 18 nt, artificial
  Chemically synthesized
aagggugaguaauuccau

SEQ ID NO: 8746 - RNA, 18 nt, artificial
  Chemically synthesized
cccuauguaucccuauca

SEQ ID NO: 8747 - RNA, 18 nt, artificial
  Chemically synthesized
gguacuaaauaugagcca

SEQ ID NO: 8748 - RNA, 18 nt, artificial
  Chemically synthesized
cccuuaucccuuaugcuu

SEQ ID NO: 8749 - RNA, 18 nt, artificial
  Chemically synthesized
agaacaacuagaacaucu

SEQ ID NO: 8750 - RNA, 18 nt, artificial
  Chemically synthesized
ggaacacuuaccuggagu

SEQ ID NO: 8751 - RNA, 18 nt, artificial
  Chemically synthesized
ggcugcuaaucucaagga

SEQ ID NO: 8752 - RNA, 18 nt, artificial
  Chemically synthesized
gcugguaucaucuucauu

SEQ ID NO: 8753 - RNA, 18 nt, artificial
  Chemically synthesized
ggcaguuucugagcaguc

SEQ ID NO: 8754 - RNA, 18 nt, artificial
  Chemically synthesized
gagaugaguucucuacuc

SEQ ID NO: 8755 - RNA, 18 nt, artificial
  Chemically synthesized
caaucucucuuuagaccu

SEQ ID NO: 8756 - RNA, 18 nt, artificial
  Chemically synthesized
gcaauuggcaggaagcaa

SEQ ID NO: 8757 - RNA, 18 nt, artificial
  Chemically synthesized
gaccaaucuagagcacuu

SEQ ID NO: 8758 - RNA, 18 nt, artificial
  Chemically synthesized
aauagggaguugucuaau

SEQ ID NO: 8759 - RNA, 18 nt, artificial
  Chemically synthesized
aggagaacuacgugugaa

SEQ ID NO: 8760 - RNA, 18 nt, artificial
  Chemically synthesized
cuaucaaguuuacagaag

SEQ ID NO: 8761 - RNA, 18 nt, artificial
  Chemically synthesized
cccuggugagugugacua

SEQ ID NO: 8762 - RNA, 18 nt, artificial
  Chemically synthesized
aguccagaaugcuaaggu

SEQ ID NO: 8763 - RNA, 18 nt, artificial
  Chemically synthesized
gugaaaacaucuaugaug

SEQ ID NO: 8764 - RNA, 18 nt, artificial
  Chemically synthesized
gugaguaauuccauggug

SEQ ID NO: 8765 - RNA, 18 nt, artificial
  Chemically synthesized
caccagaguuuccugcaa

SEQ ID NO: 8766 - RNA, 18 nt, artificial
  Chemically synthesized
gaugaauaagaccaucau

SEQ ID NO: 8767 - RNA, 18 nt, artificial
  Chemically synthesized
ccuaugaacuuuauccaa

SEQ ID NO: 8768 - RNA, 18 nt, artificial
  Chemically synthesized
gugcauuugugcacauau

SEQ ID NO: 8769 - RNA, 18 nt, artificial
  Chemically synthesized
gaauguucauccagccuc

SEQ ID NO: 8770 - RNA, 18 nt, artificial
  Chemically synthesized
gcuguuugagaugaguuc

SEQ ID NO: 8771 - RNA, 18 nt, artificial
  Chemically synthesized
agaaagagacauuguucu

SEQ ID NO: 8772 - RNA, 18 nt, artificial
  Chemically synthesized
agccgcugguguaucuuu

SEQ ID NO: 8773 - RNA, 18 nt, artificial
  Chemically synthesized
agcaguucuggucuauaa

SEQ ID NO: 8774 - RNA, 18 nt, artificial
  Chemically synthesized
guguguauuugaaagugu

SEQ ID NO: 8775 - RNA, 18 nt, artificial
  Chemically synthesized
ugugaaauccagacaauu

SEQ ID NO: 8776 - RNA, 18 nt, artificial
  Chemically synthesized
caaugugucuggaauuaa

SEQ ID NO: 8777 - RNA, 18 nt, artificial
  Chemically synthesized
ccauuuugguaguuuuga

SEQ ID NO: 8778 - RNA, 18 nt, artificial
  Chemically synthesized
gguucuuauaaagaaggu

SEQ ID NO: 8779 - RNA, 18 nt, artificial
  Chemically synthesized
guuugauggaccucugaa

SEQ ID NO: 8780 - RNA, 18 nt, artificial
  Chemically synthesized
gaagaauuccgauuagca

SEQ ID NO: 8781 - RNA, 18 nt, artificial
  Chemically synthesized
ccauugaagaauuccgau

SEQ ID NO: 8782 - RNA, 18 nt, artificial
  Chemically synthesized
cauggaauccagaaggaa

SEQ ID NO: 8783 - RNA, 18 nt, artificial
  Chemically synthesized
gguuguuuaagacgugcu

SEQ ID NO: 8784 - RNA, 18 nt, artificial
  Chemically synthesized
guauuuauugcacagacu

SEQ ID NO: 8785 - RNA, 18 nt, artificial
  Chemically synthesized
uggacaguuucccacauu

SEQ ID NO: 8786 - RNA, 18 nt, artificial
  Chemically synthesized
gggaaugcuuuuucagaa

SEQ ID NO: 8787 - RNA, 18 nt, artificial
  Chemically synthesized
ccucagaaacagaacauu

SEQ ID NO: 8788 - RNA, 18 nt, artificial
  Chemically synthesized
ggaacaguggguacagga

SEQ ID NO: 8789 - RNA, 18 nt, artificial
  Chemically synthesized
ugcugaguuugaauauca

SEQ ID NO: 8790 - RNA, 18 nt, artificial
  Chemically synthesized
ugauuacagucucaauca

SEQ ID NO: 8791 - RNA, 18 nt, artificial
  Chemically synthesized
ggauggcaacauuuagaa

SEQ ID NO: 8792 - RNA, 18 nt, artificial
  Chemically synthesized
agggaguugucuaauugg

SEQ ID NO: 8793 - RNA, 18 nt, artificial
  Chemically synthesized
agacgugcuucaaauauc

SEQ ID NO: 8794 - RNA, 18 nt, artificial
  Chemically synthesized
ccugucagaugaauaaga

SEQ ID NO: 8795 - RNA, 18 nt, artificial
  Chemically synthesized
caaccagccuaaaguauu

SEQ ID NO: 8796 - RNA, 18 nt, artificial
  Chemically synthesized
gcuucaaugguguuauua

SEQ ID NO: 8797 - RNA, 18 nt, artificial
  Chemically synthesized
agucagaaguguuuguua

SEQ ID NO: 8798 - RNA, 18 nt, artificial
  Chemically synthesized
aagccuugaguuucuaga

SEQ ID NO: 8799 - RNA, 18 nt, artificial
  Chemically synthesized
agaauuccgauuagcaua

SEQ ID NO: 8800 - RNA, 18 nt, artificial
  Chemically synthesized
guguccgcaugaucauau

SEQ ID NO: 8801 - RNA, 18 nt, artificial
  Chemically synthesized
ggguaaggaaugagcuag

SEQ ID NO: 8802 - RNA, 18 nt, artificial
  Chemically synthesized
ccuggugagugugacuau

SEQ ID NO: 8803 - RNA, 18 nt, artificial
  Chemically synthesized
guauuuagaucugagcuu

SEQ ID NO: 8804 - RNA, 18 nt, artificial
  Chemically synthesized
ccagcuggguccaacacu

SEQ ID NO: 8805 - RNA, 18 nt, artificial
  Chemically synthesized
ggcuuguccagucucgaa

SEQ ID NO: 8806 - RNA, 18 nt, artificial
  Chemically synthesized
cuugauuacagucucaau

SEQ ID NO: 8807 - RNA, 18 nt, artificial
  Chemically synthesized
cuguauagaagagagugu

SEQ ID NO: 8808 - RNA, 18 nt, artificial
  Chemically synthesized
accagaguuuccugcaau

SEQ ID NO: 8809 - RNA, 18 nt, artificial
  Chemically synthesized
ccucauuuaccuugacau

SEQ ID NO: 8810 - RNA, 18 nt, artificial
  Chemically synthesized
cuaccucgaugauauuau

SEQ ID NO: 8811 - RNA, 18 nt, artificial
  Chemically synthesized
gccugugcugaguuugaa

SEQ ID NO: 8812 - RNA, 18 nt, artificial
  Chemically synthesized
cgauuagcauacuuagac

SEQ ID NO: 8813 - RNA, 18 nt, artificial
  Chemically synthesized
ggaugcaauuggcaggaa

SEQ ID NO: 8814 - RNA, 18 nt, artificial
  Chemically synthesized
cuguggagacaaaucuag

SEQ ID NO: 8815 - RNA, 18 nt, artificial
  Chemically synthesized
cuuagaacaacuagaaca

SEQ ID NO: 8816 - RNA, 18 nt, artificial
  Chemically synthesized
aucuguuguagcaguucu

SEQ ID NO: 8817 - RNA, 18 nt, artificial
  Chemically synthesized
cuagcaucucuagagaac

SEQ ID NO: 8818 - RNA, 18 nt, artificial
  Chemically synthesized
ccauggugcacuagauau

SEQ ID NO: 8819 - RNA, 18 nt, artificial
  Chemically synthesized
cuguaaauuuggacaguu

SEQ ID NO: 8820 - RNA, 18 nt, artificial
  Chemically synthesized
gugugaaauccagacaau

SEQ ID NO: 8821 - RNA, 18 nt, artificial
  Chemically synthesized
caaggagcuuccagugca

SEQ ID NO: 8822 - RNA, 18 nt, artificial
  Chemically synthesized
acuuucacuuccaacaaa

SEQ ID NO: 8823 - RNA, 18 nt, artificial
  Chemically synthesized
ggaaaaguuugacaaauc

SEQ ID NO: 8824 - RNA, 18 nt, artificial
  Chemically synthesized
cugugcaauuugaccauu

SEQ ID NO: 8825 - RNA, 18 nt, artificial
  Chemically synthesized
ggcuggcaauucuuucca

SEQ ID NO: 8826 - RNA, 18 nt, artificial
  Chemically synthesized
ggaguauacauugcuguu

SEQ ID NO: 8827 - RNA, 18 nt, artificial
  Chemically synthesized
ccagauaucuucacagag

SEQ ID NO: 8828 - RNA, 18 nt, artificial
  Chemically synthesized
gcagcagaaguuuauuuu

SEQ ID NO: 8829 - RNA, 18 nt, artificial
  Chemically synthesized
gcaggaaggaagugggau

SEQ ID NO: 8830 - RNA, 18 nt, artificial
  Chemically synthesized
guucuggucuauaaguuc

SEQ ID NO: 8831 - RNA, 18 nt, artificial
  Chemically synthesized
ggagcuuccagugcagag

SEQ ID NO: 8832 - RNA, 18 nt, artificial
  Chemically synthesized
gggagacacagauggcug

SEQ ID NO: 8833 - RNA, 18 nt, artificial
  Chemically synthesized
accucucuaccuuaauau

SEQ ID NO: 8834 - RNA, 18 nt, artificial
  Chemically synthesized
ccacauugaaacucaaau

SEQ ID NO: 8835 - RNA, 18 nt, artificial
  Chemically synthesized
ggagcuguaccgccuucu

SEQ ID NO: 8836 - RNA, 18 nt, artificial
  Chemically synthesized
ggucuggcugguuuagaa

SEQ ID NO: 8837 - RNA, 18 nt, artificial
  Chemically synthesized
caguuucccacauugaaa

SEQ ID NO: 8838 - RNA, 18 nt, artificial
  Chemically synthesized
ggguucuacaucaaaugc

SEQ ID NO: 8839 - RNA, 18 nt, artificial
  Chemically synthesized
ccaagccuugaguuucua

SEQ ID NO: 8840 - RNA, 18 nt, artificial
  Chemically synthesized
agacuaaaauacagaguc

SEQ ID NO: 8841 - RNA, 18 nt, artificial
  Chemically synthesized
gcugcuaaucucaaggag

SEQ ID NO: 8842 - RNA, 18 nt, artificial
  Chemically synthesized
uggagaagacccugcuca

SEQ ID NO: 8843 - RNA, 18 nt, artificial
  Chemically synthesized
ucagugugcuuguaguau

SEQ ID NO: 8844 - RNA, 18 nt, artificial
  Chemically synthesized
cugccuucacuacagaga

SEQ ID NO: 8845 - RNA, 18 nt, artificial
  Chemically synthesized
cuaugaacuuuauccaac

SEQ ID NO: 8846 - RNA, 18 nt, artificial
  Chemically synthesized
gggaagaguggauguuau

SEQ ID NO: 8847 - RNA, 18 nt, artificial
  Chemically synthesized
cauccagaguuuagcccu

SEQ ID NO: 8848 - RNA, 18 nt, artificial
  Chemically synthesized
gcagaagguggagaagac

SEQ ID NO: 8849 - RNA, 18 nt, artificial
  Chemically synthesized
gguggagaagacccugcu

SEQ ID NO: 8850 - RNA, 18 nt, artificial
  Chemically synthesized
ggccauugcugccaacau

SEQ ID NO: 8851 - RNA, 18 nt, artificial
  Chemically synthesized
auagggaguugucuaauu

SEQ ID NO: 8852 - RNA, 18 nt, artificial
  Chemically synthesized
uccgcuuccuggucuuau

SEQ ID NO: 8853 - RNA, 18 nt, artificial
  Chemically synthesized
cagucaaggaacccauga

SEQ ID NO: 8854 - RNA, 18 nt, artificial
  Chemically synthesized
gcacauaucccuauguau

SEQ ID NO: 8855 - RNA, 18 nt, artificial
  Chemically synthesized
cuggugagugugacuauu

SEQ ID NO: 8856 - RNA, 18 nt, artificial
  Chemically synthesized
gcuagaggcaggaaggaa

SEQ ID NO: 8857 - RNA, 18 nt, artificial
  Chemically synthesized
ggaaacuuggaaaaguuu

SEQ ID NO: 8858 - RNA, 18 nt, artificial
  Chemically synthesized
cuugaagaauacauccau

SEQ ID NO: 8859 - RNA, 18 nt, artificial
  Chemically synthesized
aguagaaauggcuugagu

SEQ ID NO: 8860 - RNA, 18 nt, artificial
  Chemically synthesized
gucagaugaauaagacca

SEQ ID NO: 8861 - RNA, 18 nt, artificial
  Chemically synthesized
gaacaagugauguuugau

SEQ ID NO: 8862 - RNA, 18 nt, artificial
  Chemically synthesized
ugcuuugaauacaccaau

SEQ ID NO: 8863 - RNA, 18 nt, artificial
  Chemically synthesized
guuacugaguguuucaga

SEQ ID NO: 8864 - RNA, 18 nt, artificial
  Chemically synthesized
gaaacaaaaguccagaau

SEQ ID NO: 8865 - RNA, 18 nt, artificial
  Chemically synthesized
gacugaacuggguguuca

SEQ ID NO: 8866 - RNA, 18 nt, artificial
  Chemically synthesized
gucacuuugucacucgau

SEQ ID NO: 8867 - RNA, 18 nt, artificial
  Chemically synthesized
cggcacaucuucuggaga

SEQ ID NO: 8868 - RNA, 18 nt, artificial
  Chemically synthesized
gaaugacuuugcuuguac

SEQ ID NO: 8869 - RNA, 18 nt, artificial
  Chemically synthesized
gaguuucaaagguugcug

SEQ ID NO: 8870 - RNA, 18 nt, artificial
  Chemically synthesized
aguucuauuuucaccuga

SEQ ID NO: 8871 - RNA, 18 nt, artificial
  Chemically synthesized
guugaucuaccaagccuu

SEQ ID NO: 8872 - RNA, 18 nt, artificial
  Chemically synthesized
ccauuggacaucucaaaa

SEQ ID NO: 8873 - RNA, 18 nt, artificial
  Chemically synthesized
cuagaucucaguagaaau

SEQ ID NO: 8874 - RNA, 18 nt, artificial
  Chemically synthesized
ggguguucacuuuuuccu

SEQ ID NO: 8875 - RNA, 18 nt, artificial
  Chemically synthesized
agaccaucauuggugugu

SEQ ID NO: 8876 - RNA, 18 nt, artificial
  Chemically synthesized
gaaagucauuucaacucu

SEQ ID NO: 8877 - RNA, 18 nt, artificial
  Chemically synthesized
agaacuuaauguggcuca

SEQ ID NO: 8878 - RNA, 18 nt, artificial
  Chemically synthesized
gacuugcggguucuacau

SEQ ID NO: 8879 - RNA, 18 nt, artificial
  Chemically synthesized
caaccauccuggucauuc

SEQ ID NO: 8880 - RNA, 18 nt, artificial
  Chemically synthesized
agaacaucuggauuucca

SEQ ID NO: 8881 - RNA, 18 nt, artificial
  Chemically synthesized
gauugaacaucccugggu

SEQ ID NO: 8882 - RNA, 18 nt, artificial
  Chemically synthesized
gaugcuucuugcuggcug

SEQ ID NO: 8883 - RNA, 18 nt, artificial
  Chemically synthesized
caccucucuaccuuaaua

SEQ ID NO: 8884 - RNA, 18 nt, artificial
  Chemically synthesized
cugguaucaucuucauug

SEQ ID NO: 8885 - RNA, 18 nt, artificial
  Chemically synthesized
gguauucaaggcagggag

SEQ ID NO: 8886 - RNA, 18 nt, artificial
  Chemically synthesized
ggcuuagaacaacuagaa

SEQ ID NO: 8887 - RNA, 18 nt, artificial
  Chemically synthesized
agaaugacuuugcuugua

SEQ ID NO: 8888 - RNA, 18 nt, artificial
  Chemically synthesized
gccgcuuucacuuccucu

SEQ ID NO: 8889 - RNA, 18 nt, artificial
  Chemically synthesized
gaccacagucagaagugu

SEQ ID NO: 8890 - RNA, 18 nt, artificial
  Chemically synthesized
gggugaguaauuccaugg

SEQ ID NO: 8891 - RNA, 18 nt, artificial
  Chemically synthesized
gaauccagaaggaacagu

SEQ ID NO: 8892 - RNA, 18 nt, artificial
  Chemically synthesized
guggagacaaaucuagca

SEQ ID NO: 8893 - RNA, 18 nt, artificial
  Chemically synthesized
guuuccaugucucaugua

SEQ ID NO: 8894 - RNA, 18 nt, artificial
  Chemically synthesized
gauggcaacauuuagaau

SEQ ID NO: 8895 - RNA, 18 nt, artificial
  Chemically synthesized
ccacauuuugggaagagu

SEQ ID NO: 8896 - RNA, 18 nt, artificial
  Chemically synthesized
cuugaguuucaaagguug

SEQ ID NO: 8897 - RNA, 18 nt, artificial
  Chemically synthesized
ugguucugggagaauuua

SEQ ID NO: 8898 - RNA, 18 nt, artificial
  Chemically synthesized
uucacuacagagacuuua

SEQ ID NO: 8899 - RNA, 18 nt, artificial
  Chemically synthesized
aacuuguauucaaggucu

SEQ ID NO: 8900 - RNA, 18 nt, artificial
  Chemically synthesized
cauugaaacucaaaucuc

SEQ ID NO: 8901 - RNA, 18 nt, artificial
  Chemically synthesized
agcccugcguggaggugu

SEQ ID NO: 8902 - RNA, 18 nt, artificial
  Chemically synthesized
cacccuuuagcccagaac

SEQ ID NO: 8903 - RNA, 18 nt, artificial
  Chemically synthesized
gguaucaucuucauuguc

SEQ ID NO: 8904 - RNA, 18 nt, artificial
  Chemically synthesized
ccacagucagaaguguuu

SEQ ID NO: 8905 - RNA, 18 nt, artificial
  Chemically synthesized
aguacacucugucacuuu

SEQ ID NO: 8906 - RNA, 18 nt, artificial
  Chemically synthesized
ggcuucauaagcugacuu

SEQ ID NO: 8907 - RNA, 18 nt, artificial
  Chemically synthesized
ccuuauaagugucugaac

SEQ ID NO: 8908 - RNA, 18 nt, artificial
  Chemically synthesized
acuuaauguggcucacaa

SEQ ID NO: 8909 - RNA, 18 nt, artificial
  Chemically synthesized
gaguuugaauaucaccug

SEQ ID NO: 8910 - RNA, 18 nt, artificial
  Chemically synthesized
cugguguaucuuugaaua

SEQ ID NO: 8911 - RNA, 18 nt, artificial
  Chemically synthesized
guaucaucuucauugucc

SEQ ID NO: 8912 - RNA, 18 nt, artificial
  Chemically synthesized
gaaaacagaaagagacau

SEQ ID NO: 8913 - RNA, 18 nt, artificial
  Chemically synthesized
ggaggugugaaauccaga

SEQ ID NO: 8914 - RNA, 18 nt, artificial
  Chemically synthesized
acuacuaccucgaugaua

SEQ ID NO: 8915 - RNA, 18 nt, artificial
  Chemically synthesized
cagcauuccaauuugaaa

SEQ ID NO: 8916 - RNA, 18 nt, artificial
  Chemically synthesized
guucuuuuccugagucuu

SEQ ID NO: 8917 - RNA, 18 nt, artificial
  Chemically synthesized
gguguucacuuuuuccuu

SEQ ID NO: 8918 - RNA, 18 nt, artificial
  Chemically synthesized
gacaaaucugcucuagag

SEQ ID NO: 8919 - RNA, 18 nt, artificial
  Chemically synthesized
ucuugugcuuguacagua

SEQ ID NO: 8920 - RNA, 18 nt, artificial
  Chemically synthesized
ggcauaucagagccuaag

SEQ ID NO: 8921 - RNA, 18 nt, artificial
  Chemically synthesized
cacuauuuuucaaggaag

SEQ ID NO: 8922 - RNA, 18 nt, artificial
  Chemically synthesized
ggcagcucuugguggaag

SEQ ID NO: 8923 - RNA, 18 nt, artificial
  Chemically synthesized
uguagcaguucuggucua

SEQ ID NO: 8924 - RNA, 18 nt, artificial
  Chemically synthesized
gucuucagguacuaaaua

SEQ ID NO: 8925 - RNA, 18 nt, artificial
  Chemically synthesized
ucuugauuacagucucaa

SEQ ID NO: 8926 - RNA, 18 nt, artificial
  Chemically synthesized
ucucgagcauguucuauu

SEQ ID NO: 8927 - RNA, 18 nt, artificial
  Chemically synthesized
caguagaaauggcuugag

SEQ ID NO: 8928 - RNA, 18 nt, artificial
  Chemically synthesized
ggagaacuacgugugaag

SEQ ID NO: 8929 - RNA, 18 nt, artificial
  Chemically synthesized
ccaugacaaagaaaguca

SEQ ID NO: 8930 - RNA, 18 nt, artificial
  Chemically synthesized
ccagguucuugauuacag

SEQ ID NO: 8931 - RNA, 18 nt, artificial
  Chemically synthesized
ggacaauuugggcuagag

SEQ ID NO: 8932 - RNA, 18 nt, artificial
  Chemically synthesized
ugcuguucucaaagugau

SEQ ID NO: 8933 - RNA, 18 nt, artificial
  Chemically synthesized
guggguacaggaugcaau

SEQ ID NO: 8934 - RNA, 18 nt, artificial
  Chemically synthesized
agaugaauaagaccauca

SEQ ID NO: 8935 - RNA, 18 nt, artificial
  Chemically synthesized
uggagacgacucagaaaa

SEQ ID NO: 8936 - RNA, 18 nt, artificial
  Chemically synthesized
guaugguagaggugaaaa

SEQ ID NO: 8937 - RNA, 18 nt, artificial
  Chemically synthesized
caggugcauuuaaagaaa

SEQ ID NO: 8938 - RNA, 18 nt, artificial
  Chemically synthesized
gagccgcugguguaucuu

SEQ ID NO: 8939 - RNA, 18 nt, artificial
  Chemically synthesized
ugagugaguuuucaguau

SEQ ID NO: 8940 - RNA, 18 nt, artificial
  Chemically synthesized
caaguagucuagcuuucu

SEQ ID NO: 8941 - RNA, 18 nt, artificial
  Chemically synthesized
gaaauaugaccacaguca

SEQ ID NO: 8942 - RNA, 18 nt, artificial
  Chemically synthesized
gugugaagguauucaagg

SEQ ID NO: 8943 - RNA, 18 nt, artificial
  Chemically synthesized
gaacccaugacaaagaaa

SEQ ID NO: 8944 - RNA, 18 nt, artificial
  Chemically synthesized
guucaaacuucuugggcu

SEQ ID NO: 8945 - RNA, 18 nt, artificial
  Chemically synthesized
cccagaaaagaauguuca

SEQ ID NO: 8946 - RNA, 18 nt, artificial
  Chemically synthesized
gaggaagagaagacacca

SEQ ID NO: 8947 - RNA, 18 nt, artificial
  Chemically synthesized
gcuuguccagucucgaag

SEQ ID NO: 8948 - RNA, 18 nt, artificial
  Chemically synthesized
gguguuauuaccaugagu

SEQ ID NO: 8949 - RNA, 18 nt, artificial
  Chemically synthesized
aggcagggaguauacauu

SEQ ID NO: 8950 - RNA, 18 nt, artificial
  Chemically synthesized
ucucaaaaggcuuacuuu

SEQ ID NO: 8951 - RNA, 18 nt, artificial
  Chemically synthesized
gagugugacuauugaaag

SEQ ID NO: 8952 - RNA, 18 nt, artificial
  Chemically synthesized
acuagaacaucuggauuu

SEQ ID NO: 8953 - RNA, 18 nt, artificial
  Chemically synthesized
gaggacuggguaaggaau

SEQ ID NO: 8954 - RNA, 18 nt, artificial
  Chemically synthesized
acgugugaagguauucaa

SEQ ID NO: 8955 - RNA, 18 nt, artificial
  Chemically synthesized
agaccuggcaguuucuga

SEQ ID NO: 8956 - RNA, 18 nt, artificial
  Chemically synthesized
cucucagugucaacugga

SEQ ID NO: 8957 - RNA, 18 nt, artificial
  Chemically synthesized
uagaagagagugugauua

SEQ ID NO: 8958 - RNA, 18 nt, artificial
  Chemically synthesized
gccuucacuacagagacu

SEQ ID NO: 8959 - RNA, 18 nt, artificial
  Chemically synthesized
guagaaauggcuugaguu

SEQ ID NO: 8960 - RNA, 18 nt, artificial
  Chemically synthesized
gcacagacuugcggguuc

SEQ ID NO: 8961 - RNA, 18 nt, artificial
  Chemically synthesized
cuaucagggcugugugua

SEQ ID NO: 8962 - RNA, 18 nt, artificial
  Chemically synthesized
gaguugcuuucaauggca

SEQ ID NO: 8963 - RNA, 18 nt, artificial
  Chemically synthesized
cugugcugaguuugaaua

SEQ ID NO: 8964 - RNA, 18 nt, artificial
  Chemically synthesized
ggguccaacacuuguuca

SEQ ID NO: 8965 - RNA, 18 nt, artificial
  Chemically synthesized
ggcggcacaucuucugga

SEQ ID NO: 8966 - RNA, 18 nt, artificial
  Chemically synthesized
ugaguucucuacucuugu

SEQ ID NO: 8967 - RNA, 18 nt, artificial
  Chemically synthesized
ggagacgacucagaaaag

SEQ ID NO: 8968 - RNA, 18 nt, artificial
  Chemically synthesized
cccuggguguguuuccau

SEQ ID NO: 8969 - RNA, 18 nt, artificial
  Chemically synthesized
gcuuguacuugugaacac

SEQ ID NO: 8970 - RNA, 18 nt, artificial
  Chemically synthesized
gcuuugaauacaccaauu

SEQ ID NO: 8971 - RNA, 18 nt, artificial
  Chemically synthesized
uauagaagagagugugau

SEQ ID NO: 8972 - RNA, 18 nt, artificial
  Chemically synthesized
ugaacuggguguucacuu

SEQ ID NO: 8973 - RNA, 18 nt, artificial
  Chemically synthesized
ugacuuugcuuguacuug

SEQ ID NO: 8974 - RNA, 18 nt, artificial
  Chemically synthesized
cagggaguauacauugcu

SEQ ID NO: 8975 - RNA, 18 nt, artificial
  Chemically synthesized
caaggaacccaugacaaa

SEQ ID NO: 8976 - RNA, 18 nt, artificial
  Chemically synthesized
gaacauucaagaaaagga

SEQ ID NO: 8977 - RNA, 18 nt, artificial
  Chemically synthesized
guccagucucgaagucuu

SEQ ID NO: 8978 - RNA, 18 nt, artificial
  Chemically synthesized
gcuguuucuuuagccacu

SEQ ID NO: 8979 - RNA, 18 nt, artificial
  Chemically synthesized
uccaaguagucuagcuuu

SEQ ID NO: 8980 - RNA, 18 nt, artificial
  Chemically synthesized
ugacauuucucauacuca

SEQ ID NO: 8981 - RNA, 18 nt, artificial
  Chemically synthesized
guucuauuuucaccugau

SEQ ID NO: 8982 - RNA, 18 nt, artificial
  Chemically synthesized
cugcgugagaccagaaag

SEQ ID NO: 8983 - RNA, 18 nt, artificial
  Chemically synthesized
caaaggugggaaugcuuu

SEQ ID NO: 8984 - RNA, 18 nt, artificial
  Chemically synthesized
ccaacaucauccaugaag

SEQ ID NO: 8985 - RNA, 18 nt, artificial
  Chemically synthesized
cuaccuuaauauugacag

SEQ ID NO: 8986 - RNA, 18 nt, artificial
  Chemically synthesized
caacaucuaucugaagag

SEQ ID NO: 8987 - RNA, 18 nt, artificial
  Chemically synthesized
cagaguuuagcccuggga

SEQ ID NO: 8988 - RNA, 18 nt, artificial
  Chemically synthesized
gccugugcaauuugacca

SEQ ID NO: 8989 - RNA, 18 nt, artificial
  Chemically synthesized
ggugauuguugugguguc

SEQ ID NO: 8990 - RNA, 18 nt, artificial
  Chemically synthesized
uggacaucucaaaacuuu

SEQ ID NO: 8991 - RNA, 18 nt, artificial
  Chemically synthesized
cucaaucucucuuuagac

SEQ ID NO: 8992 - RNA, 18 nt, artificial
  Chemically synthesized
cuuugucacucgauguca

SEQ ID NO: 8993 - RNA, 18 nt, artificial
  Chemically synthesized
cuuggaccuuuccagcaa

SEQ ID NO: 8994 - RNA, 18 nt, artificial
  Chemically synthesized
guauagaagagaguguga

SEQ ID NO: 8995 - RNA, 18 nt, artificial
  Chemically synthesized
ccugcagaagguggagaa

SEQ ID NO: 8996 - RNA, 18 nt, artificial
  Chemically synthesized
ggguucuuauaaagaagg

SEQ ID NO: 8997 - RNA, 18 nt, artificial
  Chemically synthesized
gaugcaauuggcaggaag

SEQ ID NO: 8998 - RNA, 18 nt, artificial
  Chemically synthesized
ggagaagacccugcucag

SEQ ID NO: 8999 - RNA, 18 nt, artificial
  Chemically synthesized
gcuagacuaaaauacaga

SEQ ID NO: 9000 - RNA, 18 nt, artificial
  Chemically synthesized
ggaugguaaaucauggaa

SEQ ID NO: 9001 - RNA, 18 nt, artificial
  Chemically synthesized
cagggcugcuaaucucaa

SEQ ID NO: 9002 - RNA, 18 nt, artificial
  Chemically synthesized
gguacaggaugcaauugg

SEQ ID NO: 9003 - RNA, 18 nt, artificial
  Chemically synthesized
ccuuaucccuuaugcuug

SEQ ID NO: 9004 - RNA, 18 nt, artificial
  Chemically synthesized
cauccaugaagguuucca

SEQ ID NO: 9005 - RNA, 18 nt, artificial
  Chemically synthesized
gacuaaaauacagagucu

SEQ ID NO: 9006 - RNA, 18 nt, artificial
  Chemically synthesized
cgugagaccagaaagcug

SEQ ID NO: 9007 - RNA, 18 nt, artificial
  Chemically synthesized
cauugagaaaacaaugug

SEQ ID NO: 9008 - RNA, 18 nt, artificial
  Chemically synthesized
ccuugacauuucucauac

SEQ ID NO: 9009 - RNA, 18 nt, artificial
  Chemically synthesized
gucuagggugauugaaca

SEQ ID NO: 9010 - RNA, 18 nt, artificial
  Chemically synthesized
ggaugaugccaggaugau

SEQ ID NO: 9011 - RNA, 18 nt, artificial
  Chemically synthesized
cugucaugaaagcagcau

SEQ ID NO: 9012 - RNA, 18 nt, artificial
  Chemically synthesized
aguugcagcagaaguuua

SEQ ID NO: 9013 - RNA, 18 nt, artificial
  Chemically synthesized
cugcuuugaauacaccaa

SEQ ID NO: 9014 - RNA, 18 nt, artificial
  Chemically synthesized
cugucagaugaauaagac

SEQ ID NO: 9015 - RNA, 18 nt, artificial
  Chemically synthesized
uaagguuguuuaagacgu

SEQ ID NO: 9016 - RNA, 18 nt, artificial
  Chemically synthesized
aguucuggucuauaaguu

SEQ ID NO: 9017 - RNA, 18 nt, artificial
  Chemically synthesized
ggaagugggaugaccuca

SEQ ID NO: 9018 - RNA, 18 nt, artificial
  Chemically synthesized
cucucacccuuuagccca

SEQ ID NO: 9019 - RNA, 18 nt, artificial
  Chemically synthesized
gccaggagaacuacgugu

SEQ ID NO: 9020 - RNA, 18 nt, artificial
  Chemically synthesized
caaggcagggaguauaca

SEQ ID NO: 9021 - RNA, 18 nt, artificial
  Chemically synthesized
ccuacuaaguaaugacug

SEQ ID NO: 9022 - RNA, 18 nt, artificial
  Chemically synthesized
auuacagucucaaucaca

SEQ ID NO: 9023 - RNA, 18 nt, artificial
  Chemically synthesized
gagacuuuauucccggug

SEQ ID NO: 9024 - RNA, 18 nt, artificial
  Chemically synthesized
cauuuaacucacucucca

SEQ ID NO: 9025 - RNA, 18 nt, artificial
  Chemically synthesized
cuuccuuccagauaucuu

SEQ ID NO: 9026 - RNA, 18 nt, artificial
  Chemically synthesized
cuguucucaaagugauuu

SEQ ID NO: 9027 - RNA, 18 nt, artificial
  Chemically synthesized
gaagagaagacaccagug

SEQ ID NO: 9028 - RNA, 18 nt, artificial
  Chemically synthesized
gggacaaccagccuaaag

SEQ ID NO: 9029 - RNA, 18 nt, artificial
  Chemically synthesized
guccaacacuuguucagu

SEQ ID NO: 9030 - RNA, 18 nt, artificial
  Chemically synthesized
cuacagagacuuuauucc

SEQ ID NO: 9031 - RNA, 18 nt, artificial
  Chemically synthesized
ggacucugaucccagcca

SEQ ID NO: 9032 - RNA, 18 nt, artificial
  Chemically synthesized
gugaagguauucaaggca

SEQ ID NO: 9033 - RNA, 18 nt, artificial
  Chemically synthesized
cucgaggaagagaagaca

SEQ ID NO: 9034 - RNA, 18 nt, artificial
  Chemically synthesized
gcugcucacagaagcagu

SEQ ID NO: 9035 - RNA, 18 nt, artificial
  Chemically synthesized
ggugauugaacaucccug

SEQ ID NO: 9036 - RNA, 18 nt, artificial
  Chemically synthesized
cucacaccagaguugcuu

SEQ ID NO: 9037 - RNA, 18 nt, artificial
  Chemically synthesized
cagaaggaacagugggua

SEQ ID NO: 9038 - RNA, 18 nt, artificial
  Chemically synthesized
uugaguuucuagaucuca

SEQ ID NO: 9039 - RNA, 18 nt, artificial
  Chemically synthesized
gugcuucaaauauccaua

SEQ ID NO: 9040 - RNA, 18 nt, artificial
  Chemically synthesized
gccuccucagaaacagaa

SEQ ID NO: 9041 - RNA, 18 nt, artificial
  Chemically synthesized
cacaucuucuggagacga

SEQ ID NO: 9042 - RNA, 18 nt, artificial
  Chemically synthesized
ccaucauuggugugucgg

SEQ ID NO: 9043 - RNA, 18 nt, artificial
  Chemically synthesized
cucagaccuggcaguuuc

SEQ ID NO: 9044 - RNA, 18 nt, artificial
  Chemically synthesized
aggccuuaugcuaagggu

SEQ ID NO: 9045 - RNA, 18 nt, artificial
  Chemically synthesized
agaaguguuuguuacuga

SEQ ID NO: 9046 - RNA, 18 nt, artificial
  Chemically synthesized
ccuuaugcuaagggugag

SEQ ID NO: 9047 - RNA, 18 nt, artificial
  Chemically synthesized
cagcauuuaacucacucu

SEQ ID NO: 9048 - RNA, 18 nt, artificial
  Chemically synthesized
gccacaacaacuucuuuu

SEQ ID NO: 9049 - RNA, 18 nt, artificial
  Chemically synthesized
cagaaagagacauuguuc

SEQ ID NO: 9050 - RNA, 18 nt, artificial
  Chemically synthesized
gagacauuguucuuuucc

SEQ ID NO: 9051 - RNA, 18 nt, artificial
  Chemically synthesized
cugugacaaaagagauaa

SEQ ID NO: 9052 - RNA, 18 nt, artificial
  Chemically synthesized
gcuaauuccuaaggaaac

SEQ ID NO: 9053 - RNA, 18 nt, artificial
  Chemically synthesized
ugaauaagaccaucauug

SEQ ID NO: 9054 - RNA, 18 nt, artificial
  Chemically synthesized
cccugaacccuaugaacu

SEQ ID NO: 9055 - RNA, 18 nt, artificial
  Chemically synthesized
ugugcugaguuugaauau

SEQ ID NO: 9056 - RNA, 18 nt, artificial
  Chemically synthesized
ugcuuguacuugugaaca

SEQ ID NO: 9057 - RNA, 18 nt, artificial
  Chemically synthesized
gaccucucucagugucaa

SEQ ID NO: 9058 - RNA, 18 nt, artificial
  Chemically synthesized
guaaauuuggacaguuuc

SEQ ID NO: 9059 - RNA, 18 nt, artificial
  Chemically synthesized
caucuaugaugccuuugu

SEQ ID NO: 9060 - RNA, 18 nt, artificial
  Chemically synthesized
cagaagguggagaagacc

SEQ ID NO: 9061 - RNA, 18 nt, artificial
  Chemically synthesized
cauucaagaaaaggacaa

SEQ ID NO: 9062 - RNA, 18 nt, artificial
  Chemically synthesized
cuugaaaauggcuggcaa

SEQ ID NO: 9063 - RNA, 18 nt, artificial
  Chemically synthesized
guacuugugaacaccaga

SEQ ID NO: 9064 - RNA, 18 nt, artificial
  Chemically synthesized
guguuauuaccaugaguu

SEQ ID NO: 9065 - RNA, 18 nt, artificial
  Chemically synthesized
ggaaggaagugggaugac

SEQ ID NO: 9066 - RNA, 18 nt, artificial
  Chemically synthesized
gucuagcuuucuuaaauc

SEQ ID NO: 9067 - RNA, 18 nt, artificial
  Chemically synthesized
cuagggugauugaacauc

SEQ ID NO: 9068 - RNA, 18 nt, artificial
  Chemically synthesized
guguguuugguuugagca

SEQ ID NO: 9069 - RNA, 18 nt, artificial
  Chemically synthesized
guguguguguccgcauga

SEQ ID NO: 9070 - RNA, 18 nt, artificial
  Chemically synthesized
cagaguugcuuucaaugg

SEQ ID NO: 9071 - RNA, 18 nt, artificial
  Chemically synthesized
cgcugguguaucuuugaa

SEQ ID NO: 9072 - RNA, 18 nt, artificial
  Chemically synthesized
agcucugccuucacuaca

SEQ ID NO: 9073 - RNA, 18 nt, artificial
  Chemically synthesized
auuccauggugcacuaga

SEQ ID NO: 9074 - RNA, 18 nt, artificial
  Chemically synthesized
gucagacggugauagcga

SEQ ID NO: 9075 - RNA, 18 nt, artificial
  Chemically synthesized
ggugugucgguccucagu

SEQ ID NO: 9076 - RNA, 18 nt, artificial
  Chemically synthesized
cagagacuuuauucccgg

SEQ ID NO: 9077 - RNA, 18 nt, artificial
  Chemically synthesized
ucuaaucugaccaaucua

SEQ ID NO: 9078 - RNA, 18 nt, artificial
  Chemically synthesized
gaauaucaccugucagau

SEQ ID NO: 9079 - RNA, 18 nt, artificial
  Chemically synthesized
agccgaaaggugauuguu

SEQ ID NO: 9080 - RNA, 18 nt, artificial
  Chemically synthesized
cacagaagcagugaggau

SEQ ID NO: 9081 - RNA, 18 nt, artificial
  Chemically synthesized
ucuagcaucucuagagaa

SEQ ID NO: 9082 - RNA, 18 nt, artificial
  Chemically synthesized
ggcauuucuugcccagcu

SEQ ID NO: 9083 - RNA, 18 nt, artificial
  Chemically synthesized
gcuuacuuucacuuccaa

SEQ ID NO: 9084 - RNA, 18 nt, artificial
  Chemically synthesized
ccuggcaguuucugagca

SEQ ID NO: 9085 - RNA, 18 nt, artificial
  Chemically synthesized
gcugguuuagaaguccau

SEQ ID NO: 9086 - RNA, 18 nt, artificial
  Chemically synthesized
cagugcagagggaauaaa

SEQ ID NO: 9087 - RNA, 18 nt, artificial
  Chemically synthesized
gaagguggagaagacccu

SEQ ID NO: 9088 - RNA, 18 nt, artificial
  Chemically synthesized
gggcauaucagagccuaa

SEQ ID NO: 9089 - RNA, 18 nt, artificial
  Chemically synthesized
gcggcucgaggaagagaa

SEQ ID NO: 9090 - RNA, 18 nt, artificial
  Chemically synthesized
cgcaugaucauaucugua

SEQ ID NO: 9091 - RNA, 18 nt, artificial
  Chemically synthesized
cucagucaaggaacccau

SEQ ID NO: 9092 - RNA, 18 nt, artificial
  Chemically synthesized
gagcaguugucuccaaca

SEQ ID NO: 9093 - RNA, 18 nt, artificial
  Chemically synthesized
aggugaaaacaucuauga

SEQ ID NO: 9094 - RNA, 18 nt, artificial
  Chemically synthesized
gaggaaauagggaguugu

SEQ ID NO: 9095 - RNA, 18 nt, artificial
  Chemically synthesized
ccugaacccuaugaacuu

SEQ ID NO: 9096 - RNA, 18 nt, artificial
  Chemically synthesized
cccagcacuucauccaga

SEQ ID NO: 9097 - RNA, 18 nt, artificial
  Chemically synthesized
aguguuuguuacugagug

SEQ ID NO: 9098 - RNA, 18 nt, artificial
  Chemically synthesized
gcugaguuugaauaucac

SEQ ID NO: 9099 - RNA, 18 nt, artificial
  Chemically synthesized
augagugaguuuucagua

SEQ ID NO: 9100 - RNA, 18 nt, artificial
  Chemically synthesized
uguuguagcaguucuggu

SEQ ID NO: 9101 - RNA, 18 nt, artificial
  Chemically synthesized
gacucugaucccagccau

SEQ ID NO: 9102 - RNA, 18 nt, artificial
  Chemically synthesized
ggagugggaggacagugu

SEQ ID NO: 9103 - RNA, 18 nt, artificial
  Chemically synthesized
cuuuccagcaacaagauu

SEQ ID NO: 9104 - RNA, 18 nt, artificial
  Chemically synthesized
gagaaaacaaugugucug

SEQ ID NO: 9105 - RNA, 18 nt, artificial
  Chemically synthesized
uagcaucucuagagaacu

SEQ ID NO: 9106 - RNA, 18 nt, artificial
  Chemically synthesized
cagaaacagaacauucaa

SEQ ID NO: 9107 - RNA, 18 nt, artificial
  Chemically synthesized
cauuggacaucucaaaac

SEQ ID NO: 9108 - RNA, 18 nt, artificial
  Chemically synthesized
ugcuguuucuuuagccac

SEQ ID NO: 9109 - RNA, 18 nt, artificial
  Chemically synthesized
caaucuagagcacuugga

SEQ ID NO: 9110 - RNA, 18 nt, artificial
  Chemically synthesized
ccagccuccucagaaaca

SEQ ID NO: 9111 - RNA, 18 nt, artificial
  Chemically synthesized
cuuuagggagacacagau

SEQ ID NO: 9112 - RNA, 18 nt, artificial
  Chemically synthesized
cucuccugugacaaaaga

SEQ ID NO: 9113 - RNA, 18 nt, artificial
  Chemically synthesized
acuacagagacuuuauuc

SEQ ID NO: 9114 - RNA, 18 nt, artificial
  Chemically synthesized
cugguuuagaaguccauc

SEQ ID NO: 9115 - RNA, 18 nt, artificial
  Chemically synthesized
ugguggaaguugaacgaa

SEQ ID NO: 9116 - RNA, 18 nt, artificial
  Chemically synthesized
cagccuaaaguauuuaga

SEQ ID NO: 9117 - RNA, 18 nt, artificial
  Chemically synthesized
aaaucuagcaucucuaga

SEQ ID NO: 9118 - RNA, 18 nt, artificial
  Chemically synthesized
ggacuggguaaggaauga

SEQ ID NO: 9119 - RNA, 18 nt, artificial
  Chemically synthesized
aacucacucuccagucuu

SEQ ID NO: 9120 - RNA, 18 nt, artificial
  Chemically synthesized
ccagaguugcuuucaaug

SEQ ID NO: 9121 - RNA, 18 nt, artificial
  Chemically synthesized
agcugagaaacuugaccu

SEQ ID NO: 9122 - RNA, 18 nt, artificial
  Chemically synthesized
ugggaagaguggauguua

SEQ ID NO: 9123 - RNA, 18 nt, artificial
  Chemically synthesized
aguauacauugcuguuuc

SEQ ID NO: 9124 - RNA, 18 nt, artificial
  Chemically synthesized
ugguagaggugaaaacau

SEQ ID NO: 9125 - RNA, 18 nt, artificial
  Chemically synthesized
acaucauccaugaagguu

SEQ ID NO: 9126 - RNA, 18 nt, artificial
  Chemically synthesized
cuaaguaaugacugucau

SEQ ID NO: 9127 - RNA, 18 nt, artificial
  Chemically synthesized
cugcuaaucucaaggagc

SEQ ID NO: 9128 - RNA, 18 nt, artificial
  Chemically synthesized
ccauaaaagccgaaaggu

SEQ ID NO: 9129 - RNA, 18 nt, artificial
  Chemically synthesized
ugauggaccucugaaucu

SEQ ID NO: 9130 - RNA, 18 nt, artificial
  Chemically synthesized
gaccucugaaucucuuua

SEQ ID NO: 9131 - RNA, 18 nt, artificial
  Chemically synthesized
ugcuuucaauggcaucuu

SEQ ID NO: 9132 - RNA, 18 nt, artificial
  Chemically synthesized
cauuuaccuugacauuuc

SEQ ID NO: 9133 - RNA, 18 nt, artificial
  Chemically synthesized
ugaucuaccaagccuuga

SEQ ID NO: 9134 - RNA, 18 nt, artificial
  Chemically synthesized
cacagucagaaguguuug

SEQ ID NO: 9135 - RNA, 18 nt, artificial
  Chemically synthesized
uaaucugaccaaucuaga

SEQ ID NO: 9136 - RNA, 18 nt, artificial
  Chemically synthesized
caaaaaacaggaacuaca

SEQ ID NO: 9137 - RNA, 18 nt, artificial
  Chemically synthesized
cccacauugaaacucaaa

SEQ ID NO: 9138 - RNA, 18 nt, artificial
  Chemically synthesized
agaucucaguagaaaugg

SEQ ID NO: 9139 - RNA, 18 nt, artificial
  Chemically synthesized
uggacaauuugggcuaga

SEQ ID NO: 9140 - RNA, 18 nt, artificial
  Chemically synthesized
gcuccuugaccacauuuu

SEQ ID NO: 9141 - RNA, 18 nt, artificial
  Chemically synthesized
cacuagauaugcagggcu

SEQ ID NO: 9142 - RNA, 18 nt, artificial
  Chemically synthesized
guaaugacugucaugaaa

SEQ ID NO: 9143 - RNA, 18 nt, artificial
  Chemically synthesized
guuucuuuagccacuggu

SEQ ID NO: 9144 - RNA, 18 nt, artificial
  Chemically synthesized
gaaggaacaguggguaca

SEQ ID NO: 9145 - RNA, 18 nt, artificial
  Chemically synthesized
cuggucuauaaguucuau

SEQ ID NO: 9146 - RNA, 18 nt, artificial
  Chemically synthesized
aguaucuguuguagcagu

SEQ ID NO: 9147 - RNA, 18 nt, artificial
  Chemically synthesized
gcauacuuagacuacuac

SEQ ID NO: 9148 - RNA, 18 nt, artificial
  Chemically synthesized
gguaguuuugacugaacu

SEQ ID NO: 9149 - RNA, 18 nt, artificial
  Chemically synthesized
agggugaguaauuccaug

SEQ ID NO: 9150 - RNA, 18 nt, artificial
  Chemically synthesized
cuuaauguggcucacaau

SEQ ID NO: 9151 - RNA, 18 nt, artificial
  Chemically synthesized
ggucauucucgagcaugu

SEQ ID NO: 9152 - RNA, 18 nt, artificial
  Chemically synthesized
ccuauguaucccuaucag

SEQ ID NO: 9153 - RNA, 18 nt, artificial
  Chemically synthesized
agguugcuguucucaaag

SEQ ID NO: 9154 - RNA, 18 nt, artificial
  Chemically synthesized
cagucgugcugguaucau

SEQ ID NO: 9155 - RNA, 18 nt, artificial
  Chemically synthesized
gaguguuucagagugugu

SEQ ID NO: 9156 - RNA, 18 nt, artificial
  Chemically synthesized
uccagacaauugaagaug

SEQ ID NO: 9157 - RNA, 18 nt, artificial
  Chemically synthesized
gacuggguaaggaaugag

SEQ ID NO: 9158 - RNA, 18 nt, artificial
  Chemically synthesized
gcugcauaaaguauggua

SEQ ID NO: 9159 - RNA, 18 nt, artificial
  Chemically synthesized
acguuuccuuauaagugu

SEQ ID NO: 9160 - RNA, 18 nt, artificial
  Chemically synthesized
ggcaaugcuccuugacca

SEQ ID NO: 9161 - RNA, 18 nt, artificial
  Chemically synthesized
guccagaaugcuaagguu

SEQ ID NO: 9162 - RNA, 18 nt, artificial
  Chemically synthesized
cuuacucagaaugacuuu

SEQ ID NO: 9163 - RNA, 18 nt, artificial
  Chemically synthesized
ccagaaugcuaagguugc

SEQ ID NO: 9164 - RNA, 18 nt, artificial
  Chemically synthesized
agacauuguucuuuuccu

SEQ ID NO: 9165 - RNA, 18 nt, artificial
  Chemically synthesized
accugucccugaacccua

SEQ ID NO: 9166 - RNA, 18 nt, artificial
  Chemically synthesized
agaacaagugauguuuga

SEQ ID NO: 9167 - RNA, 18 nt, artificial
  Chemically synthesized
agguauucaaggcaggga

SEQ ID NO: 9168 - RNA, 18 nt, artificial
  Chemically synthesized
caauggcuuguccagucu

SEQ ID NO: 9169 - RNA, 18 nt, artificial
  Chemically synthesized
aagggagaaaugaggaaa

SEQ ID NO: 9170 - RNA, 18 nt, artificial
  Chemically synthesized
cggguucuacaucaaaug

SEQ ID NO: 9171 - RNA, 18 nt, artificial
  Chemically synthesized
gagcuucaaugguguuau

SEQ ID NO: 9172 - RNA, 18 nt, artificial
  Chemically synthesized
accagaguugcuuucaau

SEQ ID NO: 9173 - RNA, 18 nt, artificial
  Chemically synthesized
ggugcacuagauaugcag

SEQ ID NO: 9174 - RNA, 18 nt, artificial
  Chemically synthesized
uagccaucauaaaaccau

SEQ ID NO: 9175 - RNA, 18 nt, artificial
  Chemically synthesized
gagaaaugaggaaauagg

SEQ ID NO: 9176 - RNA, 18 nt, artificial
  Chemically synthesized
gaaugagcuaguaaagaa

SEQ ID NO: 9177 - RNA, 18 nt, artificial
  Chemically synthesized
cugaguguuucagagugu

SEQ ID NO: 9178 - RNA, 18 nt, artificial
  Chemically synthesized
gguagaggugaaaacauc

SEQ ID NO: 9179 - RNA, 18 nt, artificial
  Chemically synthesized
gaccaucauugguguguc

SEQ ID NO: 9180 - RNA, 18 nt, artificial
  Chemically synthesized
ggucugcaggcguuuucu

SEQ ID NO: 9181 - RNA, 18 nt, artificial
  Chemically synthesized
ugaguuucuagaucucag

SEQ ID NO: 9182 - RNA, 18 nt, artificial
  Chemically synthesized
agcaucucuagagaacuu

SEQ ID NO: 9183 - RNA, 18 nt, artificial
  Chemically synthesized
gugugucgguccucagug

SEQ ID NO: 9184 - RNA, 18 nt, artificial
  Chemically synthesized
gcuaaucucaaggagcuu

SEQ ID NO: 9185 - RNA, 18 nt, artificial
  Chemically synthesized
cuucuucuaacuuccucu

SEQ ID NO: 9186 - RNA, 18 nt, artificial
  Chemically synthesized
cuuugaauacaccaauug

SEQ ID NO: 9187 - RNA, 18 nt, artificial
  Chemically synthesized
gaacaguggguacaggau

SEQ ID NO: 9188 - RNA, 18 nt, artificial
  Chemically synthesized
caaggucuggcugguuua

SEQ ID NO: 9189 - RNA, 18 nt, artificial
  Chemically synthesized
cucauuuaccuugacauu

SEQ ID NO: 9190 - RNA, 18 nt, artificial
  Chemically synthesized
guucucuacucuugugcu

SEQ ID NO: 9191 - RNA, 18 nt, artificial
  Chemically synthesized
caaugguguuauuaccau

SEQ ID NO: 9192 - RNA, 18 nt, artificial
  Chemically synthesized
uguguuuccaugucucau

SEQ ID NO: 9193 - RNA, 18 nt, artificial
  Chemically synthesized
uucaaagguugcuguucu

SEQ ID NO: 9194 - RNA, 18 nt, artificial
  Chemically synthesized
uggucuuaucauggacaa

SEQ ID NO: 9195 - RNA, 18 nt, artificial
  Chemically synthesized
caucuucuggagacgacu

SEQ ID NO: 9196 - RNA, 18 nt, artificial
  Chemically synthesized
gguuugagcaggucuagg

SEQ ID NO: 9197 - RNA, 18 nt, artificial
  Chemically synthesized
aguugucaaaacuggaaa

SEQ ID NO: 9198 - RNA, 18 nt, artificial
  Chemically synthesized
ccuuuagcccagaacugc

SEQ ID NO: 9199 - RNA, 18 nt, artificial
  Chemically synthesized
gugaguuuucaguauucc

SEQ ID NO: 9200 - RNA, 18 nt, artificial
  Chemically synthesized
aucccuauguaucccuau

SEQ ID NO: 9201 - RNA, 18 nt, artificial
  Chemically synthesized
ccaggugggcauuucaac

SEQ ID NO: 9202 - RNA, 18 nt, artificial
  Chemically synthesized
gcuguucucaaagugauu

SEQ ID NO: 9203 - RNA, 18 nt, artificial
  Chemically synthesized
caguugucuccaacagca

SEQ ID NO: 9204 - RNA, 18 nt, artificial
  Chemically synthesized
ccaaguagucuagcuuuc

SEQ ID NO: 9205 - RNA, 18 nt, artificial
  Chemically synthesized
gaagaaaauuuccgcuuc

SEQ ID NO: 9206 - RNA, 18 nt, artificial
  Chemically synthesized
ccuccugaggcauuucuu

SEQ ID NO: 9207 - RNA, 18 nt, artificial
  Chemically synthesized
ccugcaauggaucaagga

SEQ ID NO: 9208 - RNA, 18 nt, artificial
  Chemically synthesized
uaccaugaguucaaacuu

SEQ ID NO: 9209 - RNA, 18 nt, artificial
  Chemically synthesized
ccgauuagcauacuuaga

SEQ ID NO: 9210 - RNA, 18 nt, artificial
  Chemically synthesized
gugggcauuucaaccaac

SEQ ID NO: 9211 - RNA, 18 nt, artificial
  Chemically synthesized
gaaacaaaugagugaguu

SEQ ID NO: 9212 - RNA, 18 nt, artificial
  Chemically synthesized
ggaccagaggcagcucuu

SEQ ID NO: 9213 - RNA, 18 nt, artificial
  Chemically synthesized
ugcacauaucccuaugua

SEQ ID NO: 9214 - RNA, 18 nt, artificial
  Chemically synthesized
cuuauaagugucugaacu

SEQ ID NO: 9215 - RNA, 18 nt, artificial
  Chemically synthesized
cucauguacuagugaaag

SEQ ID NO: 9216 - RNA, 18 nt, artificial
  Chemically synthesized
ugcuaagguugccgcuuu

SEQ ID NO: 9217 - RNA, 18 nt, artificial
  Chemically synthesized
ggagccuuuucuggacua

SEQ ID NO: 9218 - RNA, 18 nt, artificial
  Chemically synthesized
caggaagcaacaucuauc

SEQ ID NO: 9219 - RNA, 18 nt, artificial
  Chemically synthesized
uaauguggcucacaaucu

SEQ ID NO: 9220 - RNA, 18 nt, artificial
  Chemically synthesized
agcuguaccgccuucuca

SEQ ID NO: 9221 - RNA, 18 nt, artificial
  Chemically synthesized
gcauuucaaccaacucag

SEQ ID NO: 9222 - RNA, 18 nt, artificial
  Chemically synthesized
ccaugucucauguacuag

SEQ ID NO: 9223 - RNA, 18 nt, artificial
  Chemically synthesized
gcucacagaagcagugag

SEQ ID NO: 9224 - RNA, 18 nt, artificial
  Chemically synthesized
cauuuuccaaguagucua

SEQ ID NO: 9225 - RNA, 18 nt, artificial
  Chemically synthesized
agaagguggagaagaccc

SEQ ID NO: 9226 - RNA, 18 nt, artificial
  Chemically synthesized
ucagaacaagugauguuu

SEQ ID NO: 9227 - RNA, 18 nt, artificial
  Chemically synthesized
aguguuucagaguguguu

SEQ ID NO: 9228 - RNA, 18 nt, artificial
  Chemically synthesized
augaguugcagcagaagu

SEQ ID NO: 9229 - RNA, 18 nt, artificial
  Chemically synthesized
gcucacaaucuuauccaa

SEQ ID NO: 9230 - RNA, 18 nt, artificial
  Chemically synthesized
cccuuuagcccagaacug

SEQ ID NO: 9231 - RNA, 18 nt, artificial
  Chemically synthesized
ugaccauugaagaauucc

SEQ ID NO: 9232 - RNA, 18 nt, artificial
  Chemically synthesized
cacucugucacuuuguca

SEQ ID NO: 9233 - RNA, 18 nt, artificial
  Chemically synthesized
uggcuguuugagaugagu

SEQ ID NO: 9234 - RNA, 18 nt, artificial
  Chemically synthesized
guuguuuaagacgugcuu

SEQ ID NO: 9235 - RNA, 18 nt, artificial
  Chemically synthesized
cucuccugcgugagacca

SEQ ID NO: 9236 - RNA, 18 nt, artificial
  Chemically synthesized
agacuuuauucccggugu

SEQ ID NO: 9237 - RNA, 18 nt, artificial
  Chemically synthesized
cacaaucuuauccaaucu

SEQ ID NO: 9238 - RNA, 18 nt, artificial
  Chemically synthesized
aaaacuuccuuccagaua

SEQ ID NO: 9239 - RNA, 18 nt, artificial
  Chemically synthesized
caagaaaaggacaaucag

SEQ ID NO: 9240 - RNA, 18 nt, artificial
  Chemically synthesized
uaccaagccuugaguuuc

SEQ ID NO: 9241 - RNA, 18 nt, artificial
  Chemically synthesized
acucuuaccucaucaagu

SEQ ID NO: 9242 - RNA, 18 nt, artificial
  Chemically synthesized
guguuucagaguguguuu

SEQ ID NO: 9243 - RNA, 18 nt, artificial
  Chemically synthesized
ccagaaaagaauguucau

SEQ ID NO: 9244 - RNA, 18 nt, artificial
  Chemically synthesized
ggucaccuuuucuugauu

SEQ ID NO: 9245 - RNA, 18 nt, artificial
  Chemically synthesized
gcuggaugguaaaucaug

SEQ ID NO: 9246 - RNA, 18 nt, artificial
  Chemically synthesized
cagguucuugauuacagu

SEQ ID NO: 9247 - RNA, 18 nt, artificial
  Chemically synthesized
guuucaaagguugcuguu

SEQ ID NO: 9248 - RNA, 18 nt, artificial
  Chemically synthesized
cucucucagugucaacug

SEQ ID NO: 9249 - RNA, 18 nt, artificial
  Chemically synthesized
aacuacgugugaagguau

SEQ ID NO: 9250 - RNA, 18 nt, artificial
  Chemically synthesized
agaggugaaaacaucuau

SEQ ID NO: 9251 - RNA, 18 nt, artificial
  Chemically synthesized
acaaaucuagcaucucua

SEQ ID NO: 9252 - RNA, 18 nt, artificial
  Chemically synthesized
aagacgugcuucaaauau

SEQ ID NO: 9253 - RNA, 18 nt, artificial
  Chemically synthesized
ugccuucacuacagagac

SEQ ID NO: 9254 - RNA, 18 nt, artificial
  Chemically synthesized
aguggauguuaucauuga

SEQ ID NO: 9255 - RNA, 18 nt, artificial
  Chemically synthesized
ugaacuuuauccaaccag

SEQ ID NO: 9256 - RNA, 18 nt, artificial
  Chemically synthesized
agaaaacagaaagagaca

SEQ ID NO: 9257 - RNA, 18 nt, artificial
  Chemically synthesized
gcugagaaacuugaccuu

SEQ ID NO: 9258 - RNA, 18 nt, artificial
  Chemically synthesized
ugcucacagaagcaguga

SEQ ID NO: 9259 - RNA, 18 nt, artificial
  Chemically synthesized
uuugagaugaguucucua

SEQ ID NO: 9260 - RNA, 18 nt, artificial
  Chemically synthesized
agcacuucauccagagcc

SEQ ID NO: 9261 - RNA, 18 nt, artificial
  Chemically synthesized
aguggguacaggaugcaa

SEQ ID NO: 9262 - RNA, 18 nt, artificial
  Chemically synthesized
ccagacaauugaagaugg

SEQ ID NO: 9263 - RNA, 18 nt, artificial
  Chemically synthesized
gcgccuggcugggacucu

SEQ ID NO: 9264 - RNA, 18 nt, artificial
  Chemically synthesized
ucugggagaauuuagaaa

SEQ ID NO: 9265 - RNA, 18 nt, artificial
  Chemically synthesized
uggguaaggaaugagcua

SEQ ID NO: 9266 - RNA, 18 nt, artificial
  Chemically synthesized
gaaggaaacuuggaaaag

SEQ ID NO: 9267 - RNA, 18 nt, artificial
  Chemically synthesized
gagaagacaccagugccu

SEQ ID NO: 9268 - RNA, 18 nt, artificial
  Chemically synthesized
uauaauuucggauggcaa

SEQ ID NO: 9269 - RNA, 18 nt, artificial
  Chemically synthesized
aucuggauuuccagcauu

SEQ ID NO: 9270 - RNA, 18 nt, artificial
  Chemically synthesized
acccuuuagcccagaacu

SEQ ID NO: 9271 - RNA, 18 nt, artificial
  Chemically synthesized
acagaaagagacauuguu

SEQ ID NO: 9272 - RNA, 18 nt, artificial
  Chemically synthesized
gucuggcugguuuagaag

SEQ ID NO: 9273 - RNA, 18 nt, artificial
  Chemically synthesized
gagcaggucuagggugau

SEQ ID NO: 9274 - RNA, 18 nt, artificial
  Chemically synthesized
cuuccagugcagagggaa

SEQ ID NO: 9275 - RNA, 18 nt, artificial
  Chemically synthesized
cuuguacaguagucuccc

SEQ ID NO: 9276 - RNA, 18 nt, artificial
  Chemically synthesized
gccuaaaguauuuagauc

SEQ ID NO: 9277 - RNA, 18 nt, artificial
  Chemically synthesized
cuuucacuuccaacaaag

SEQ ID NO: 9278 - RNA, 18 nt, artificial
  Chemically synthesized
caaccaggugcauuuaaa

SEQ ID NO: 9279 - RNA, 18 nt, artificial
  Chemically synthesized
gcuggguccaacacuugu

SEQ ID NO: 9280 - RNA, 18 nt, artificial
  Chemically synthesized
gaucuaccaagccuugag

SEQ ID NO: 9281 - RNA, 18 nt, artificial
  Chemically synthesized
ccgaaaggugauuguugu

SEQ ID NO: 9282 - RNA, 18 nt, artificial
  Chemically synthesized
uggucauucucgagcaug

SEQ ID NO: 9283 - RNA, 18 nt, artificial
  Chemically synthesized
auuggauacguuuccuua

SEQ ID NO: 9284 - RNA, 18 nt, artificial
  Chemically synthesized
gauacguuuccuuauaag

SEQ ID NO: 9285 - RNA, 18 nt, artificial
  Chemically synthesized
ucacuacagagacuuuau

SEQ ID NO: 9286 - RNA, 18 nt, artificial
  Chemically synthesized
cucgaagucuugaaaaug

SEQ ID NO: 9287 - RNA, 18 nt, artificial
  Chemically synthesized
guucauccagccuccuca

SEQ ID NO: 9288 - RNA, 18 nt, artificial
  Chemically synthesized
gcaguuucugagcagucg

SEQ ID NO: 9289 - RNA, 18 nt, artificial
  Chemically synthesized
agcacuuggaccuuucca

SEQ ID NO: 9290 - RNA, 18 nt, artificial
  Chemically synthesized
caucuggauuuccagcau

SEQ ID NO: 9291 - RNA, 18 nt, artificial
  Chemically synthesized
gugcugguaucaucuuca

SEQ ID NO: 9292 - RNA, 18 nt, artificial
  Chemically synthesized
cuucaaugguguuauuac

SEQ ID NO: 9293 - RNA, 18 nt, artificial
  Chemically synthesized
gggaagaaaauuuccgcu

SEQ ID NO: 9294 - RNA, 18 nt, artificial
  Chemically synthesized
agcaggucuagggugauu

SEQ ID NO: 9295 - RNA, 18 nt, artificial
  Chemically synthesized
cuucacagagcugagaaa

SEQ ID NO: 9296 - RNA, 18 nt, artificial
  Chemically synthesized
cccuuccauuuuaagucu

SEQ ID NO: 9297 - RNA, 18 nt, artificial
  Chemically synthesized
ggaaaacuuccuuccaga

SEQ ID NO: 9298 - RNA, 18 nt, artificial
  Chemically synthesized
cauguacuagugaaagua

SEQ ID NO: 9299 - RNA, 18 nt, artificial
  Chemically synthesized
cgugugaagguauucaag

SEQ ID NO: 9300 - RNA, 18 nt, artificial
  Chemically synthesized
cgcuuucacuuccucuca

SEQ ID NO: 9301 - RNA, 18 nt, artificial
  Chemically synthesized
agaguguguuugguuuga

SEQ ID NO: 9302 - RNA, 18 nt, artificial
  Chemically synthesized
ugaguuugaauaucaccu

SEQ ID NO: 9303 - RNA, 18 nt, artificial
  Chemically synthesized
gaggaagggagaaaugag

SEQ ID NO: 9304 - RNA, 18 nt, artificial
  Chemically synthesized
cauuguucuuuuccugag

SEQ ID NO: 9305 - RNA, 18 nt, artificial
  Chemically synthesized
agccaucauaaaaccauu

SEQ ID NO: 9306 - RNA, 18 nt, artificial
  Chemically synthesized
caccuuuucuugauucca

SEQ ID NO: 9307 - RNA, 18 nt, artificial
  Chemically synthesized
guagaugugugcauuugu

SEQ ID NO: 9308 - RNA, 18 nt, artificial
  Chemically synthesized
caaaaggcuuacuuucac

SEQ ID NO: 9309 - RNA, 18 nt, artificial
  Chemically synthesized
caaugcuccuugaccaca

SEQ ID NO: 9310 - RNA, 18 nt, artificial
  Chemically synthesized
agcauacuuagacuacua

SEQ ID NO: 9311 - RNA, 18 nt, artificial
  Chemically synthesized
gggcaugccugugcugag

SEQ ID NO: 9312 - RNA, 18 nt, artificial
  Chemically synthesized
cauccuggucauucucga

SEQ ID NO: 9313 - RNA, 18 nt, artificial
  Chemically synthesized
gaaagagacauuguucuu

SEQ ID NO: 9314 - RNA, 18 nt, artificial
  Chemically synthesized
caacaaaggugggaaugc

SEQ ID NO: 9315 - RNA, 18 nt, artificial
  Chemically synthesized
cuuugaauaugagauugc

SEQ ID NO: 9316 - RNA, 18 nt, artificial
  Chemically synthesized
caucuucauuguccugca

SEQ ID NO: 9317 - RNA, 18 nt, artificial
  Chemically synthesized
gaacuggguguucacuuu

SEQ ID NO: 9318 - RNA, 18 nt, artificial
  Chemically synthesized
ugaggacuggguaaggaa

SEQ ID NO: 9319 - RNA, 18 nt, artificial
  Chemically synthesized
aagucuaguggcuaauuc

SEQ ID NO: 9320 - RNA, 18 nt, artificial
  Chemically synthesized
gggcuccugaugcaagau

SEQ ID NO: 9321 - RNA, 18 nt, artificial
  Chemically synthesized
ccacuggucugcaggcgu

SEQ ID NO: 9322 - RNA, 18 nt, artificial
  Chemically synthesized
gaaguauggaaaaguaca

SEQ ID NO: 9323 - RNA, 18 nt, artificial
  Chemically synthesized
guuuccuuauaagugucu

SEQ ID NO: 9324 - RNA, 18 nt, artificial
  Chemically synthesized
cagaaaagaauguucauc

SEQ ID NO: 9325 - RNA, 18 nt, artificial
  Chemically synthesized
gaaaccugauuaacacau

SEQ ID NO: 9326 - RNA, 18 nt, artificial
  Chemically synthesized
gaaaguagaugugugcau

SEQ ID NO: 9327 - RNA, 18 nt, artificial
  Chemically synthesized
uguucuuuuccugagucu

SEQ ID NO: 9328 - RNA, 18 nt, artificial
  Chemically synthesized
caugaguucaaacuucuu

SEQ ID NO: 9329 - RNA, 18 nt, artificial
  Chemically synthesized
cccuacucaaucucucuu

SEQ ID NO: 9330 - RNA, 18 nt, artificial
  Chemically synthesized
auuuccgcuuccuggucu

SEQ ID NO: 9331 - RNA, 18 nt, artificial
  Chemically synthesized
ugagugugacuauugaaa

SEQ ID NO: 9332 - RNA, 18 nt, artificial
  Chemically synthesized
gacacagauggcugggau

SEQ ID NO: 9333 - RNA, 18 nt, artificial
  Chemically synthesized
ugagaaaacaaugugucu

SEQ ID NO: 9334 - RNA, 18 nt, artificial
  Chemically synthesized
agagaagacaccagugcc

SEQ ID NO: 9335 - RNA, 18 nt, artificial
  Chemically synthesized
ggaugaggacuggguaag

SEQ ID NO: 9336 - RNA, 18 nt, artificial
  Chemically synthesized
auaugaccacagucagaa

SEQ ID NO: 9337 - RNA, 18 nt, artificial
  Chemically synthesized
cauacuuagacuacuacc

SEQ ID NO: 9338 - RNA, 18 nt, artificial
  Chemically synthesized
ccuuuucuggacuaucaa

SEQ ID NO: 9339 - RNA, 18 nt, artificial
  Chemically synthesized
cuacuaccucgaugauau

SEQ ID NO: 9340 - RNA, 18 nt, artificial
  Chemically synthesized
acaccagugccucagaaa

SEQ ID NO: 9341 - RNA, 18 nt, artificial
  Chemically synthesized
aucucucuuuagaccugu

SEQ ID NO: 9342 - RNA, 18 nt, artificial
  Chemically synthesized
gagccacaacaacuucuu

SEQ ID NO: 9343 - RNA, 18 nt, artificial
  Chemically synthesized
gugugcuuguaguaucug

SEQ ID NO: 9344 - RNA, 18 nt, artificial
  Chemically synthesized
acucaaucucucuuuaga

SEQ ID NO: 9345 - RNA, 18 nt, artificial
  Chemically synthesized
aucuguauagaagagagu

SEQ ID NO: 9346 - RNA, 18 nt, artificial
  Chemically synthesized
acucgaugucauuccaaa

SEQ ID NO: 9347 - RNA, 18 nt, artificial
  Chemically synthesized
aagagaagacaccagugc

SEQ ID NO: 9348 - RNA, 18 nt, artificial
  Chemically synthesized
ccugugcaauuugaccau

SEQ ID NO: 9349 - RNA, 18 nt, artificial
  Chemically synthesized
aaggaaaccugauuaaca

SEQ ID NO: 9350 - RNA, 18 nt, artificial
  Chemically synthesized
gcaacaccuucagauaag

SEQ ID NO: 9351 - RNA, 18 nt, artificial
  Chemically synthesized
gaucugagcuucaauggu

SEQ ID NO: 9352 - RNA, 18 nt, artificial
  Chemically synthesized
cucuccagucuucaggua

SEQ ID NO: 9353 - RNA, 18 nt, artificial
  Chemically synthesized
agugauguuugauggacc

SEQ ID NO: 9354 - RNA, 18 nt, artificial
  Chemically synthesized
cuuguaguaucuguugua

SEQ ID NO: 9355 - RNA, 18 nt, artificial
  Chemically synthesized
cugcaauggaucaaggac

SEQ ID NO: 9356 - RNA, 18 nt, artificial
  Chemically synthesized
gaauaagaccaucauugg

SEQ ID NO: 9357 - RNA, 18 nt, artificial
  Chemically synthesized
gaaagaacuuaauguggc

SEQ ID NO: 9358 - RNA, 18 nt, artificial
  Chemically synthesized
auuccuaucacucagaaa

SEQ ID NO: 9359 - RNA, 18 nt, artificial
  Chemically synthesized
auaagguuguuuaagacg

SEQ ID NO: 9360 - RNA, 18 nt, artificial
  Chemically synthesized
agaccagaaagcugggag

SEQ ID NO: 9361 - RNA, 18 nt, artificial
  Chemically synthesized
ccauuucagcucugccuu

SEQ ID NO: 9362 - RNA, 18 nt, artificial
  Chemically synthesized
caagugauguuugaugga

SEQ ID NO: 9363 - RNA, 18 nt, artificial
  Chemically synthesized
uccucuccugugacaaaa

SEQ ID NO: 9364 - RNA, 18 nt, artificial
  Chemically synthesized
cucacucuccagucuuca

SEQ ID NO: 9365 - RNA, 18 nt, artificial
  Chemically synthesized
gaaugugcaacaccuuca

SEQ ID NO: 9366 - RNA, 18 nt, artificial
  Chemically synthesized
uguuaucuacucaagcca

SEQ ID NO: 9367 - RNA, 18 nt, artificial
  Chemically synthesized
uccucagugugcuuguag

SEQ ID NO: 9368 - RNA, 18 nt, artificial
  Chemically synthesized
guccgcaugaucauaucu

SEQ ID NO: 9369 - RNA, 18 nt, artificial
  Chemically synthesized
cauggacaauuugggcua

SEQ ID NO: 9370 - RNA, 18 nt, artificial
  Chemically synthesized
uggcuguggagacaaauc

SEQ ID NO: 9371 - RNA, 18 nt, artificial
  Chemically synthesized
cugauuaacacaugcuca

SEQ ID NO: 9372 - RNA, 18 nt, artificial
  Chemically synthesized
aauccagacaauugaaga

SEQ ID NO: 9373 - RNA, 18 nt, artificial
  Chemically synthesized
ggguacaggaugcaauug

SEQ ID NO: 9374 - RNA, 18 nt, artificial
  Chemically synthesized
aguuucaaagguugcugu

SEQ ID NO: 9375 - RNA, 18 nt, artificial
  Chemically synthesized
ccagaaagcugggagccc

SEQ ID NO: 9376 - RNA, 18 nt, artificial
  Chemically synthesized
gccacaugucaggccuua

SEQ ID NO: 9377 - RNA, 18 nt, artificial
  Chemically synthesized
agucauuucaacucuuac

SEQ ID NO: 9378 - RNA, 18 nt, artificial
  Chemically synthesized
gucagaaguguuuguuac

SEQ ID NO: 9379 - RNA, 18 nt, artificial
  Chemically synthesized
gcuuucacuuccucucac

SEQ ID NO: 9380 - RNA, 18 nt, artificial
  Chemically synthesized
accucauuuaccuugaca

SEQ ID NO: 9381 - RNA, 18 nt, artificial
  Chemically synthesized
ccauccagaguuuagccc

SEQ ID NO: 9382 - RNA, 18 nt, artificial
  Chemically synthesized
ccacugcugcucacagaa

SEQ ID NO: 9383 - RNA, 18 nt, artificial
  Chemically synthesized
gaguuuagcccugggagc

SEQ ID NO: 9384 - RNA, 18 nt, artificial
  Chemically synthesized
gccaccucucuaccuuaa

SEQ ID NO: 9385 - RNA, 18 nt, artificial
  Chemically synthesized
augcuaagguugccgcuu

SEQ ID NO: 9386 - RNA, 18 nt, artificial
  Chemically synthesized
caugucucauguacuagu

SEQ ID NO: 9387 - RNA, 18 nt, artificial
  Chemically synthesized
accaugaguucaaacuuc

SEQ ID NO: 9388 - RNA, 18 nt, artificial
  Chemically synthesized
guguucacuuuuuccuuu

SEQ ID NO: 9389 - RNA, 18 nt, artificial
  Chemically synthesized
uaugcuaagggugaguaa

SEQ ID NO: 9390 - RNA, 18 nt, artificial
  Chemically synthesized
cuacucaaucucucuuua

SEQ ID NO: 9391 - RNA, 18 nt, artificial
  Chemically synthesized
agccacaacaacuucuuu

SEQ ID NO: 9392 - RNA, 18 nt, artificial
  Chemically synthesized
gaguaauuccauggugca

SEQ ID NO: 9393 - RNA, 18 nt, artificial
  Chemically synthesized
aagugauguuugauggac

SEQ ID NO: 9394 - RNA, 18 nt, artificial
  Chemically synthesized
cagagcugagaaacuuga

SEQ ID NO: 9395 - RNA, 18 nt, artificial
  Chemically synthesized
guuuagcccugggagccu

SEQ ID NO: 9396 - RNA, 18 nt, artificial
  Chemically synthesized
agggagacacagauggcu

SEQ ID NO: 9397 - RNA, 18 nt, artificial
  Chemically synthesized
augcagggcugcuaaucu

SEQ ID NO: 9398 - RNA, 18 nt, artificial
  Chemically synthesized
aaacaaaaguccagaaug

SEQ ID NO: 9399 - RNA, 18 nt, artificial
  Chemically synthesized
acucaaaucucucaaaag

SEQ ID NO: 9400 - RNA, 18 nt, artificial
  Chemically synthesized
aacagaaagagacauugu

SEQ ID NO: 9401 - RNA, 18 nt, artificial
  Chemically synthesized
uguacuagugaaaguaga

SEQ ID NO: 9402 - RNA, 18 nt, artificial
  Chemically synthesized
caucucuagagaacuucc

SEQ ID NO: 9403 - RNA, 18 nt, artificial
  Chemically synthesized
ccuggucauucucgagca

SEQ ID NO: 9404 - RNA, 18 nt, artificial
  Chemically synthesized
uaagggugaguaauucca

SEQ ID NO: 9405 - RNA, 18 nt, artificial
  Chemically synthesized
aaggcuuacuuucacuuc

SEQ ID NO: 9406 - RNA, 18 nt, artificial
  Chemically synthesized
cucgagcauguucuauuu

SEQ ID NO: 9407 - RNA, 18 nt, artificial
  Chemically synthesized
ugcuccuugaccacauuu

SEQ ID NO: 9408 - RNA, 18 nt, artificial
  Chemically synthesized
aauucuacuugaugacug

SEQ ID NO: 9409 - RNA, 18 nt, artificial
  Chemically synthesized
ccucucucagugucaacu

SEQ ID NO: 9410 - RNA, 18 nt, artificial
  Chemically synthesized
gucccugaacccuaugaa

SEQ ID NO: 9411 - RNA, 18 nt, artificial
  Chemically synthesized
cauuguccugcagaaggu

SEQ ID NO: 9412 - RNA, 18 nt, artificial
  Chemically synthesized
aggguaaaagacuuuucu

SEQ ID NO: 9413 - RNA, 18 nt, artificial
  Chemically synthesized
cacugcugcucacagaag

SEQ ID NO: 9414 - RNA, 18 nt, artificial
  Chemically synthesized
gaugucauuccaaaguua

SEQ ID NO: 9415 - RNA, 18 nt, artificial
  Chemically synthesized
cucagaaaccucauuuac

SEQ ID NO: 9416 - RNA, 18 nt, artificial
  Chemically synthesized
cuggguguguuuccaugu

SEQ ID NO: 9417 - RNA, 18 nt, artificial
  Chemically synthesized
gcaucuucaauggcuugu

SEQ ID NO: 9418 - RNA, 18 nt, artificial
  Chemically synthesized
augaaagcagcauugaaa

SEQ ID NO: 9419 - RNA, 18 nt, artificial
  Chemically synthesized
gauggaccucugaaucuc

SEQ ID NO: 9420 - RNA, 18 nt, artificial
  Chemically synthesized
aguugucuccaacagcau

SEQ ID NO: 9421 - RNA, 18 nt, artificial
  Chemically synthesized
agagccuaagccaccucu

SEQ ID NO: 9422 - RNA, 18 nt, artificial
  Chemically synthesized
cccuaucagggcugugug

SEQ ID NO: 9423 - RNA, 18 nt, artificial
  Chemically synthesized
guguguuuccaugucuca

SEQ ID NO: 9424 - RNA, 18 nt, artificial
  Chemically synthesized
ccagaguuuccugcaaug

SEQ ID NO: 9425 - RNA, 18 nt, artificial
  Chemically synthesized
aguuugaauaucaccugu

SEQ ID NO: 9426 - RNA, 18 nt, artificial
  Chemically synthesized
uuugguucugggagaauu

SEQ ID NO: 9427 - RNA, 18 nt, artificial
  Chemically synthesized
guugcagcagaaguuuau

SEQ ID NO: 9428 - RNA, 18 nt, artificial
  Chemically synthesized
guguuuccaugucucaug

SEQ ID NO: 9429 - RNA, 18 nt, artificial
  Chemically synthesized
caacuagaacaucuggau

SEQ ID NO: 9430 - RNA, 18 nt, artificial
  Chemically synthesized
uagggaguugucuaauug

SEQ ID NO: 9431 - RNA, 18 nt, artificial
  Chemically synthesized
cucagugugcuuguagua

SEQ ID NO: 9432 - RNA, 18 nt, artificial
  Chemically synthesized
cugucuccuuacagaggu

SEQ ID NO: 9433 - RNA, 18 nt, artificial
  Chemically synthesized
cuugugaacaccagaguu

SEQ ID NO: 9434 - RNA, 18 nt, artificial
  Chemically synthesized
cuuccaaaaaacaggaac

SEQ ID NO: 9435 - RNA, 18 nt, artificial
  Chemically synthesized
caacuggagcaguugucu

SEQ ID NO: 9436 - RNA, 18 nt, artificial
  Chemically synthesized
guuucuucauuuucccug

SEQ ID NO: 9437 - RNA, 18 nt, artificial
  Chemically synthesized
uguuugagaugaguucuc

SEQ ID NO: 9438 - RNA, 18 nt, artificial
  Chemically synthesized
accuuuccagcaacaaga

SEQ ID NO: 9439 - RNA, 18 nt, artificial
  Chemically synthesized
gccuacuaaguaaugacu

SEQ ID NO: 9440 - RNA, 18 nt, artificial
  Chemically synthesized
agaaaugaaggaaacuug

SEQ ID NO: 9441 - RNA, 18 nt, artificial
  Chemically synthesized
gcaugccugugcugaguu

SEQ ID NO: 9442 - RNA, 18 nt, artificial
  Chemically synthesized
ggaaugcuuuuucagaag

SEQ ID NO: 9443 - RNA, 18 nt, artificial
  Chemically synthesized
aacuagaacaucuggauu

SEQ ID NO: 9444 - RNA, 18 nt, artificial
  Chemically synthesized
ugcagcagaaguuuauuu

SEQ ID NO: 9445 - RNA, 18 nt, artificial
  Chemically synthesized
uacugaguguuucagagu

SEQ ID NO: 9446 - RNA, 18 nt, artificial
  Chemically synthesized
aaggcagggaguauacau

SEQ ID NO: 9447 - RNA, 18 nt, artificial
  Chemically synthesized
agcauuuaacucacucuc

SEQ ID NO: 9448 - RNA, 18 nt, artificial
  Chemically synthesized
gagccuuuucuggacuau

SEQ ID NO: 9449 - RNA, 18 nt, artificial
  Chemically synthesized
agugucaacuggagcagu

SEQ ID NO: 9450 - RNA, 18 nt, artificial
  Chemically synthesized
cacauaucccuauguauc

SEQ ID NO: 9451 - RNA, 18 nt, artificial
  Chemically synthesized
cuucauuguccugcagaa

SEQ ID NO: 9452 - RNA, 18 nt, artificial
  Chemically synthesized
auaugagauugcucagac

SEQ ID NO: 9453 - RNA, 18 nt, artificial
  Chemically synthesized
gcuuuuucagaaguugau

SEQ ID NO: 9454 - RNA, 18 nt, artificial
  Chemically synthesized
gaaauccagacaauugaa

SEQ ID NO: 9455 - RNA, 18 nt, artificial
  Chemically synthesized
cagauaucuucacagagc

SEQ ID NO: 9456 - RNA, 18 nt, artificial
  Chemically synthesized
gaaaggugauuguugugg

SEQ ID NO: 9457 - RNA, 18 nt, artificial
  Chemically synthesized
cuaugaugccuuuguuau

SEQ ID NO: 9458 - RNA, 18 nt, artificial
  Chemically synthesized
ccgccuucucagcaggaa

SEQ ID NO: 9459 - RNA, 18 nt, artificial
  Chemically synthesized
caccagugccucagaaac

SEQ ID NO: 9460 - RNA, 18 nt, artificial
  Chemically synthesized
acagacuugcggguucua

SEQ ID NO: 9461 - RNA, 18 nt, artificial
  Chemically synthesized
aaacuuguauucaagguc

SEQ ID NO: 9462 - RNA, 18 nt, artificial
  Chemically synthesized
cuaucugaagaggaaaaa

SEQ ID NO: 9463 - RNA, 18 nt, artificial
  Chemically synthesized
cagagccgcugguguauc

SEQ ID NO: 9464 - RNA, 18 nt, artificial
  Chemically synthesized
aguucaaacuucuugggc

SEQ ID NO: 9465 - RNA, 18 nt, artificial
  Chemically synthesized
gcccugggagccuuuucu

SEQ ID NO: 9466 - RNA, 18 nt, artificial
  Chemically synthesized
accaacucagucaaggaa

SEQ ID NO: 9467 - RNA, 18 nt, artificial
  Chemically synthesized
ggaggacaguguccuggg

SEQ ID NO: 9468 - RNA, 18 nt, artificial
  Chemically synthesized
accacagucagaaguguu

SEQ ID NO: 9469 - RNA, 18 nt, artificial
  Chemically synthesized
gaagcugguggcugugga

SEQ ID NO: 9470 - RNA, 18 nt, artificial
  Chemically synthesized
accuugacauuucucaua

SEQ ID NO: 9471 - RNA, 18 nt, artificial
  Chemically synthesized
ugcacagacuugcggguu

SEQ ID NO: 9472 - RNA, 18 nt, artificial
  Chemically synthesized
aaguguguguguccgcau

SEQ ID NO: 9473 - RNA, 18 nt, artificial
  Chemically synthesized
agucuaguggcuaauucc

SEQ ID NO: 9474 - RNA, 18 nt, artificial
  Chemically synthesized
cuuuguuaucuacucaag

SEQ ID NO: 9475 - RNA, 18 nt, artificial
  Chemically synthesized
gguuuagaaguccaucgu

SEQ ID NO: 9476 - RNA, 18 nt, artificial
  Chemically synthesized
accauugaagaauuccga

SEQ ID NO: 9477 - RNA, 18 nt, artificial
  Chemically synthesized
agggcaugccugugcuga

SEQ ID NO: 9478 - RNA, 18 nt, artificial
  Chemically synthesized
gugugacuauugaaaggg

SEQ ID NO: 9479 - RNA, 18 nt, artificial
  Chemically synthesized
cuggcugguuuagaaguc

SEQ ID NO: 9480 - RNA, 18 nt, artificial
  Chemically synthesized
aaggaaacuuggaaaagu

SEQ ID NO: 9481 - RNA, 18 nt, artificial
  Chemically synthesized
guccucagugugcuugua

SEQ ID NO: 9482 - RNA, 18 nt, artificial
  Chemically synthesized
aagcaacaucuaucugaa

SEQ ID NO: 9483 - RNA, 18 nt, artificial
  Chemically synthesized
guggaggugugaaaucca

SEQ ID NO: 9484 - RNA, 18 nt, artificial
  Chemically synthesized
cucaaaucucucaaaagg

SEQ ID NO: 9485 - RNA, 18 nt, artificial
  Chemically synthesized
uugugaacaccagaguuu

SEQ ID NO: 9486 - RNA, 18 nt, artificial
  Chemically synthesized
ugaccacagucagaagug

SEQ ID NO: 9487 - RNA, 18 nt, artificial
  Chemically synthesized
gaaugcuuuuucagaagu

SEQ ID NO: 9488 - RNA, 18 nt, artificial
  Chemically synthesized
cugcaggcguuuucuucu

SEQ ID NO: 9489 - RNA, 18 nt, artificial
  Chemically synthesized
uguuuguuacugaguguu

SEQ ID NO: 9490 - RNA, 18 nt, artificial
  Chemically synthesized
gaagcagugaggaugaug

SEQ ID NO: 9491 - RNA, 18 nt, artificial
  Chemically synthesized
ucgagcauguucuauuuu

SEQ ID NO: 9492 - RNA, 18 nt, artificial
  Chemically synthesized
ggugggaaugcuuuuuca

SEQ ID NO: 9493 - RNA, 18 nt, artificial
  Chemically synthesized
agguucccagaaaagaau

SEQ ID NO: 9494 - RNA, 18 nt, artificial
  Chemically synthesized
cauugcuguuuccuguug

SEQ ID NO: 9495 - RNA, 18 nt, artificial
  Chemically synthesized
gcguggaggugugaaauc

SEQ ID NO: 9496 - RNA, 18 nt, artificial
  Chemically synthesized
ccagagccgcugguguau

SEQ ID NO: 9497 - RNA, 18 nt, artificial
  Chemically synthesized
gaaaauuuccgcuuccug

SEQ ID NO: 9498 - RNA, 18 nt, artificial
  Chemically synthesized
gaacugcuuugaauacac

SEQ ID NO: 9499 - RNA, 18 nt, artificial
  Chemically synthesized
agucugucuccuuacaga

SEQ ID NO: 9500 - RNA, 18 nt, artificial
  Chemically synthesized
agggaguauacauugcug

SEQ ID NO: 9501 - RNA, 18 nt, artificial
  Chemically synthesized
uccagaaugcuaagguug

SEQ ID NO: 9502 - RNA, 18 nt, artificial
  Chemically synthesized
ccuggaccucucucagug

SEQ ID NO: 9503 - RNA, 18 nt, artificial
  Chemically synthesized
cuguuucuuuagccacug

SEQ ID NO: 9504 - RNA, 18 nt, artificial
  Chemically synthesized
gcuggcugcauaaaguau

SEQ ID NO: 9505 - RNA, 18 nt, artificial
  Chemically synthesized
gaaguugaacgaauggaa

SEQ ID NO: 9506 - RNA, 18 nt, artificial
  Chemically synthesized
ucuuuagggagacacaga

SEQ ID NO: 9507 - RNA, 18 nt, artificial
  Chemically synthesized
auuucggauggcaacauu

SEQ ID NO: 9508 - RNA, 18 nt, artificial
  Chemically synthesized
cuacuugaugacugcagu

SEQ ID NO: 9509 - RNA, 18 nt, artificial
  Chemically synthesized
guuaucuacucaagccag

SEQ ID NO: 9510 - RNA, 18 nt, artificial
  Chemically synthesized
uuccgauuagcauacuua

SEQ ID NO: 9511 - RNA, 18 nt, artificial
  Chemically synthesized
aguauuuagaucugagcu

SEQ ID NO: 9512 - RNA, 18 nt, artificial
  Chemically synthesized
gaagguuuccauaaaagc

SEQ ID NO: 9513 - RNA, 18 nt, artificial
  Chemically synthesized
ugcuuguacaguagucuc

SEQ ID NO: 9514 - RNA, 18 nt, artificial
  Chemically synthesized
ugaguuucaaagguugcu

SEQ ID NO: 9515 - RNA, 18 nt, artificial
  Chemically synthesized
gccaucauaaaaccauuu

SEQ ID NO: 9516 - RNA, 18 nt, artificial
  Chemically synthesized
acuugugaacaccagagu

SEQ ID NO: 9517 - RNA, 18 nt, artificial
  Chemically synthesized
caaaugagugaguuuuca

SEQ ID NO: 9518 - RNA, 18 nt, artificial
  Chemically synthesized
caaaucucucaaaaggcu

SEQ ID NO: 9519 - RNA, 18 nt, artificial
  Chemically synthesized
gagcagucgugcugguau

SEQ ID NO: 9520 - RNA, 18 nt, artificial
  Chemically synthesized
acucagucaaggaaccca

SEQ ID NO: 9521 - RNA, 18 nt, artificial
  Chemically synthesized
uagaaauggcuugaguuu

SEQ ID NO: 9522 - RNA, 18 nt, artificial
  Chemically synthesized
uuucuaaucugaccaauc

SEQ ID NO: 9523 - RNA, 18 nt, artificial
  Chemically synthesized
ucagaguguguuugguuu

SEQ ID NO: 9524 - RNA, 18 nt, artificial
  Chemically synthesized
uccgcaugaucauaucug

SEQ ID NO: 9525 - RNA, 18 nt, artificial
  Chemically synthesized
gagacgacucagaaaagc

SEQ ID NO: 9526 - RNA, 18 nt, artificial
  Chemically synthesized
cugaguuugaauaucacc

SEQ ID NO: 9527 - RNA, 18 nt, artificial
  Chemically synthesized
cucaaucacauaaugacu

SEQ ID NO: 9528 - RNA, 18 nt, artificial
  Chemically synthesized
gggaggacaguguccugg

SEQ ID NO: 9529 - RNA, 18 nt, artificial
  Chemically synthesized
cauuuugggaagagugga

SEQ ID NO: 9530 - RNA, 18 nt, artificial
  Chemically synthesized
ccaacaaaggugggaaug

SEQ ID NO: 9531 - RNA, 18 nt, artificial
  Chemically synthesized
cauuucaaccaacucagu

SEQ ID NO: 9532 - RNA, 18 nt, artificial
  Chemically synthesized
ugagaaacuugaccuucc

SEQ ID NO: 9533 - RNA, 18 nt, artificial
  Chemically synthesized
guuguagcaguucugguc

SEQ ID NO: 9534 - RNA, 18 nt, artificial
  Chemically synthesized
cagcuggguccaacacuu

SEQ ID NO: 9535 - RNA, 18 nt, artificial
  Chemically synthesized
ggaaaccugauuaacaca

SEQ ID NO: 9536 - RNA, 18 nt, artificial
  Chemically synthesized
ugucaugaaagcagcauu

SEQ ID NO: 9537 - RNA, 18 nt, artificial
  Chemically synthesized
ugcaauuugaccauugaa

SEQ ID NO: 9538 - RNA, 18 nt, artificial
  Chemically synthesized
ugaacccuaugaacuuua

SEQ ID NO: 9539 - RNA, 18 nt, artificial
  Chemically synthesized
gaaaagcccugcuggaug

SEQ ID NO: 9540 - RNA, 18 nt, artificial
  Chemically synthesized
gcuuguacaguagucucc

SEQ ID NO: 9541 - RNA, 18 nt, artificial
  Chemically synthesized
aaacaaugugucuggaau

SEQ ID NO: 9542 - RNA, 18 nt, artificial
  Chemically synthesized
auggcuugaguuucaaag

SEQ ID NO: 9543 - RNA, 18 nt, artificial
  Chemically synthesized
aguagaugugugcauuug

SEQ ID NO: 9544 - RNA, 18 nt, artificial
  Chemically synthesized
gagaaacuugaccuuccu

SEQ ID NO: 9545 - RNA, 18 nt, artificial
  Chemically synthesized
gguucccagaaaagaaug

SEQ ID NO: 9546 - RNA, 18 nt, artificial
  Chemically synthesized
ucuguauagaagagagug

SEQ ID NO: 9547 - RNA, 18 nt, artificial
  Chemically synthesized
cagccauggccuuccucu

SEQ ID NO: 9548 - RNA, 18 nt, artificial
  Chemically synthesized
auaagaccaucauuggug

SEQ ID NO: 9549 - RNA, 18 nt, artificial
  Chemically synthesized
augccuuuguuaucuacu

SEQ ID NO: 9550 - RNA, 18 nt, artificial
  Chemically synthesized
agcaguugucuccaacag

SEQ ID NO: 9551 - RNA, 18 nt, artificial
  Chemically synthesized
ucuggacuaucaaguuua

SEQ ID NO: 9552 - RNA, 18 nt, artificial
  Chemically synthesized
gaagaguggauguuauca

SEQ ID NO: 9553 - RNA, 18 nt, artificial
  Chemically synthesized
gaaaagaauguucaucca

SEQ ID NO: 9554 - RNA, 18 nt, artificial
  Chemically synthesized
gagccuaagccaccucuc

SEQ ID NO: 9555 - RNA, 18 nt, artificial
  Chemically synthesized
gaauggaaugugcaacac

SEQ ID NO: 9556 - RNA, 18 nt, artificial
  Chemically synthesized
gaacaucccugggugugu

SEQ ID NO: 9557 - RNA, 18 nt, artificial
  Chemically synthesized
cuuuagcccagaacugcu

SEQ ID NO: 9558 - RNA, 18 nt, artificial
  Chemically synthesized
caacacuuguucaguuaa

SEQ ID NO: 9559 - RNA, 18 nt, artificial
  Chemically synthesized
gaaggaagugggaugacc

SEQ ID NO: 9560 - RNA, 18 nt, artificial
  Chemically synthesized
gaaaauggcuggcaauuc

SEQ ID NO: 9561 - RNA, 18 nt, artificial
  Chemically synthesized
ccacaugucaggccuuau

SEQ ID NO: 9562 - RNA, 18 nt, artificial
  Chemically synthesized
uucggauggcaacauuua

SEQ ID NO: 9563 - RNA, 18 nt, artificial
  Chemically synthesized
agugaguuuucaguauuc

SEQ ID NO: 9564 - RNA, 18 nt, artificial
  Chemically synthesized
gagcugagaaacuugacc

SEQ ID NO: 9565 - RNA, 18 nt, artificial
  Chemically synthesized
aagguucccagaaaagaa

SEQ ID NO: 9566 - RNA, 18 nt, artificial
  Chemically synthesized
aagguugcuguucucaaa

SEQ ID NO: 9567 - RNA, 18 nt, artificial
  Chemically synthesized
gguggagcuguaccgccu

SEQ ID NO: 9568 - RNA, 18 nt, artificial
  Chemically synthesized
auucaguugucaaaacug

SEQ ID NO: 9569 - RNA, 18 nt, artificial
  Chemically synthesized
uccaggugggcauuucaa

SEQ ID NO: 9570 - RNA, 18 nt, artificial
  Chemically synthesized
ugagauugcucagaccug

SEQ ID NO: 9571 - RNA, 18 nt, artificial
  Chemically synthesized
aaaggaggaagggagaaa

SEQ ID NO: 9572 - RNA, 18 nt, artificial
  Chemically synthesized
caacagcauuuaacucac

SEQ ID NO: 9573 - RNA, 18 nt, artificial
  Chemically synthesized
ugaagguauucaaggcag

SEQ ID NO: 9574 - RNA, 18 nt, artificial
  Chemically synthesized
cuauguaucccuaucagg

SEQ ID NO: 9575 - RNA, 18 nt, artificial
  Chemically synthesized
ggcaugccugugcugagu

SEQ ID NO: 9576 - RNA, 18 nt, artificial
  Chemically synthesized
gaccuggcaguuucugag

SEQ ID NO: 9577 - RNA, 18 nt, artificial
  Chemically synthesized
cuggcaguuucugagcag

SEQ ID NO: 9578 - RNA, 18 nt, artificial
  Chemically synthesized
cuccaacagcauuuaacu

SEQ ID NO: 9579 - RNA, 18 nt, artificial
  Chemically synthesized
agaaaagcccugcuggau

SEQ ID NO: 9580 - RNA, 18 nt, artificial
  Chemically synthesized
aguugcuuucaauggcau

SEQ ID NO: 9581 - RNA, 18 nt, artificial
  Chemically synthesized
ugcuuuuucagaaguuga

SEQ ID NO: 9582 - RNA, 18 nt, artificial
  Chemically synthesized
ugcauaaaguaugguaga

SEQ ID NO: 9583 - RNA, 18 nt, artificial
  Chemically synthesized
aggaaguauggaaaagua

SEQ ID NO: 9584 - RNA, 18 nt, artificial
  Chemically synthesized
cacauuuugggaagagug

SEQ ID NO: 9585 - RNA, 18 nt, artificial
  Chemically synthesized
caacucuuaccucaucaa

SEQ ID NO: 9586 - RNA, 18 nt, artificial
  Chemically synthesized
aauggaucaaggaccaga

SEQ ID NO: 9587 - RNA, 18 nt, artificial
  Chemically synthesized
gggccugugcaauuugac

SEQ ID NO: 9588 - RNA, 18 nt, artificial
  Chemically synthesized
ugugaacaccagaguuuc

SEQ ID NO: 9589 - RNA, 18 nt, artificial
  Chemically synthesized
gugagaccagaaagcugg

SEQ ID NO: 9590 - RNA, 18 nt, artificial
  Chemically synthesized
ugacugucaugaaagcag

SEQ ID NO: 9591 - RNA, 18 nt, artificial
  Chemically synthesized
aaauaugagccacaacaa

SEQ ID NO: 9592 - RNA, 18 nt, artificial
  Chemically synthesized
cgguccucagugugcuug

SEQ ID NO: 9593 - RNA, 18 nt, artificial
  Chemically synthesized
ucucaguagaaauggcuu

SEQ ID NO: 9594 - RNA, 18 nt, artificial
  Chemically synthesized
gcuguguguauuugaaag

SEQ ID NO: 9595 - RNA, 18 nt, artificial
  Chemically synthesized
cuccucagaaacagaaca

SEQ ID NO: 9596 - RNA, 18 nt, artificial
  Chemically synthesized
cuguuguagcaguucugg

SEQ ID NO: 9597 - RNA, 18 nt, artificial
  Chemically synthesized
gagaacuacgugugaagg

SEQ ID NO: 9598 - RNA, 18 nt, artificial
  Chemically synthesized
uuucaguauuccuaucac

SEQ ID NO: 9599 - RNA, 18 nt, artificial
  Chemically synthesized
ugaugccuuuguuaucua

SEQ ID NO: 9600 - RNA, 18 nt, artificial
  Chemically synthesized
ccuaucacucagaaaccu

SEQ ID NO: 9601 - RNA, 18 nt, artificial
  Chemically synthesized
uggcuugaguuucaaagg

SEQ ID NO: 9602 - RNA, 18 nt, artificial
  Chemically synthesized
cuacuaaguaaugacugu

SEQ ID NO: 9603 - RNA, 18 nt, artificial
  Chemically synthesized
agaauguucauccagccu

SEQ ID NO: 9604 - RNA, 18 nt, artificial
  Chemically synthesized
gaauacaccaauugcugu

SEQ ID NO: 9605 - RNA, 18 nt, artificial
  Chemically synthesized
cagcauuuuccaaguagu

SEQ ID NO: 9606 - RNA, 18 nt, artificial
  Chemically synthesized
cagaaagcugggagcccu

SEQ ID NO: 9607 - RNA, 18 nt, artificial
  Chemically synthesized
gguugccgcuuucacuuc

SEQ ID NO: 9608 - RNA, 18 nt, artificial
  Chemically synthesized
acagcauuuuccaaguag

SEQ ID NO: 9609 - RNA, 18 nt, artificial
  Chemically synthesized
uugcuguucucaaaguga

SEQ ID NO: 9610 - RNA, 18 nt, artificial
  Chemically synthesized
cuguguguauuugaaagu

SEQ ID NO: 9611 - RNA, 18 nt, artificial
  Chemically synthesized
cucucuuuagaccugucc

SEQ ID NO: 9612 - RNA, 18 nt, artificial
  Chemically synthesized
uuuaagacgugcuucaaa

SEQ ID NO: 9613 - RNA, 18 nt, artificial
  Chemically synthesized
gagaccagaaagcuggga

SEQ ID NO: 9614 - RNA, 18 nt, artificial
  Chemically synthesized
uauucaaggcagggagua

SEQ ID NO: 9615 - RNA, 18 nt, artificial
  Chemically synthesized
aggagcuuccagugcaga

SEQ ID NO: 9616 - RNA, 18 nt, artificial
  Chemically synthesized
acaacuagaacaucugga

SEQ ID NO: 9617 - RNA, 18 nt, artificial
  Chemically synthesized
cuucagauaagcagggca

SEQ ID NO: 9618 - RNA, 18 nt, artificial
  Chemically synthesized
aaggaaugagcuaguaaa

SEQ ID NO: 9619 - RNA, 18 nt, artificial
  Chemically synthesized
cguuuucuucuucuaacu

SEQ ID NO: 9620 - RNA, 18 nt, artificial
  Chemically synthesized
ucuucuucuaacuuccuc

SEQ ID NO: 9621 - RNA, 18 nt, artificial
  Chemically synthesized
cauuucucauacucacac

SEQ ID NO: 9622 - RNA, 18 nt, artificial
  Chemically synthesized
accugaugcuucuugcug

SEQ ID NO: 9623 - RNA, 18 nt, artificial
  Chemically synthesized
acuaaauaugagccacaa

SEQ ID NO: 9624 - RNA, 18 nt, artificial
  Chemically synthesized
uacguuuccuuauaagug

SEQ ID NO: 9625 - RNA, 18 nt, artificial
  Chemically synthesized
guauucaaggucuggcug

SEQ ID NO: 9626 - RNA, 18 nt, artificial
  Chemically synthesized
cgcuuccuggucuuauca

SEQ ID NO: 9627 - RNA, 18 nt, artificial
  Chemically synthesized
ugaauaugagauugcuca

SEQ ID NO: 9628 - RNA, 18 nt, artificial
  Chemically synthesized
acugaguguuucagagug

SEQ ID NO: 9629 - RNA, 18 nt, artificial
  Chemically synthesized
gagugggaggacaguguc

SEQ ID NO: 9630 - RNA, 18 nt, artificial
  Chemically synthesized
cuuccuggucuuaucaug

SEQ ID NO: 9631 - RNA, 18 nt, artificial
  Chemically synthesized
ucaaaaggcuuacuuuca

SEQ ID NO: 9632 - RNA, 18 nt, artificial
  Chemically synthesized
uaucuguuguagcaguuc

SEQ ID NO: 9633 - RNA, 18 nt, artificial
  Chemically synthesized
auaucagagccuaagcca

SEQ ID NO: 9634 - RNA, 18 nt, artificial
  Chemically synthesized
acuguaaauuuggacagu

SEQ ID NO: 9635 - RNA, 18 nt, artificial
  Chemically synthesized
gauuuccagcauuccaau

SEQ ID NO: 9636 - RNA, 18 nt, artificial
  Chemically synthesized
agaaaaggacaaucagga

SEQ ID NO: 9637 - RNA, 18 nt, artificial
  Chemically synthesized
ucuauggcuguuugagau

SEQ ID NO: 9638 - RNA, 18 nt, artificial
  Chemically synthesized
aaaagaauguucauccag

SEQ ID NO: 9639 - RNA, 18 nt, artificial
  Chemically synthesized
uucacuuccaacaaaggu

SEQ ID NO: 9640 - RNA, 18 nt, artificial
  Chemically synthesized
cagaagcagugaggauga

SEQ ID NO: 9641 - RNA, 18 nt, artificial
  Chemically synthesized
ccuguacccuucucacug

SEQ ID NO: 9642 - RNA, 18 nt, artificial
  Chemically synthesized
cuagagcacuuggaccuu

SEQ ID NO: 9643 - RNA, 18 nt, artificial
  Chemically synthesized
gaaaugaggaaauaggga

SEQ ID NO: 9644 - RNA, 18 nt, artificial
  Chemically synthesized
ucacaaccauccugguca

SEQ ID NO: 9645 - RNA, 18 nt, artificial
  Chemically synthesized
aaacaucuaugaugccuu

SEQ ID NO: 9646 - RNA, 18 nt, artificial
  Chemically synthesized
gugauuuugggacaacca

SEQ ID NO: 9647 - RNA, 18 nt, artificial
  Chemically synthesized
cagcaacaagauucaaag

SEQ ID NO: 9648 - RNA, 18 nt, artificial
  Chemically synthesized
uucuuuagccacuggucu

SEQ ID NO: 9649 - RNA, 18 nt, artificial
  Chemically synthesized
ggcaggaaggaaguggga

SEQ ID NO: 9650 - RNA, 18 nt, artificial
  Chemically synthesized
guguuuguuacugagugu

SEQ ID NO: 9651 - RNA, 18 nt, artificial
  Chemically synthesized
ucucuacucuugugcuug

SEQ ID NO: 9652 - RNA, 18 nt, artificial
  Chemically synthesized
agaaagucauuucaacuc

SEQ ID NO: 9653 - RNA, 18 nt, artificial
  Chemically synthesized
aaguguuuguuacugagu

SEQ ID NO: 9654 - RNA, 18 nt, artificial
  Chemically synthesized
agacuacuaccucgauga

SEQ ID NO: 9655 - RNA, 18 nt, artificial
  Chemically synthesized
aagaguggauguuaucau

SEQ ID NO: 9656 - RNA, 18 nt, artificial
  Chemically synthesized
gugggaggacaguguccu

SEQ ID NO: 9657 - RNA, 18 nt, artificial
  Chemically synthesized
cugggagccuuuucugga

SEQ ID NO: 9658 - RNA, 18 nt, artificial
  Chemically synthesized
gugucaacuggagcaguu

SEQ ID NO: 9659 - RNA, 18 nt, artificial
  Chemically synthesized
ugggcauuucaaccaacu

SEQ ID NO: 9660 - RNA, 18 nt, artificial
  Chemically synthesized
caaaucugcucuagaggg

SEQ ID NO: 9661 - RNA, 18 nt, artificial
  Chemically synthesized
ucuggucuauaaguucua

SEQ ID NO: 9662 - RNA, 18 nt, artificial
  Chemically synthesized
auuucaacucuuaccuca

SEQ ID NO: 9663 - RNA, 18 nt, artificial
  Chemically synthesized
gucuccaacagcauuuaa

SEQ ID NO: 9664 - RNA, 18 nt, artificial
  Chemically synthesized
aagaagguucccagaaaa

SEQ ID NO: 9665 - RNA, 18 nt, artificial
  Chemically synthesized
cauccauuugaaauggau

SEQ ID NO: 9666 - RNA, 18 nt, artificial
  Chemically synthesized
uggaaauaugaccacagu

SEQ ID NO: 9667 - RNA, 18 nt, artificial
  Chemically synthesized
ugagccacaacaacuucu

SEQ ID NO: 9668 - RNA, 18 nt, artificial
  Chemically synthesized
cuguuuccuguugggcaa

SEQ ID NO: 9669 - RNA, 18 nt, artificial
  Chemically synthesized
cugaccaaucuagagcac

SEQ ID NO: 9670 - RNA, 18 nt, artificial
  Chemically synthesized
uggguguguuuccauguc

SEQ ID NO: 9671 - RNA, 18 nt, artificial
  Chemically synthesized
aacaggaacuacagcauu

SEQ ID NO: 9672 - RNA, 18 nt, artificial
  Chemically synthesized
cuugcuggcugcauaaag

SEQ ID NO: 9673 - RNA, 18 nt, artificial
  Chemically synthesized
aucuacucaagccaggau

SEQ ID NO: 9674 - RNA, 18 nt, artificial
  Chemically synthesized
guuucagaguguguuugg

SEQ ID NO: 9675 - RNA, 18 nt, artificial
  Chemically synthesized
cagugaggaugaugccag

SEQ ID NO: 9676 - RNA, 18 nt, artificial
  Chemically synthesized
acucagaaaccucauuua

SEQ ID NO: 9677 - RNA, 18 nt, artificial
  Chemically synthesized
aguucucuacucuugugc

SEQ ID NO: 9678 - RNA, 18 nt, artificial
  Chemically synthesized
gauagcgagccacgcauu

SEQ ID NO: 9679 - RNA, 18 nt, artificial
  Chemically synthesized
gacaauuugggcuagagg

SEQ ID NO: 9680 - RNA, 18 nt, artificial
  Chemically synthesized
uccugagucuuuugaaug

SEQ ID NO: 9681 - RNA, 18 nt, artificial
  Chemically synthesized
uuucaaagguugcuguuc

SEQ ID NO: 9682 - RNA, 18 nt, artificial
  Chemically synthesized
uacucuugugcuuguaca

SEQ ID NO: 9683 - RNA, 18 nt, artificial
  Chemically synthesized
guugucuccaacagcauu

SEQ ID NO: 9684 - RNA, 18 nt, artificial
  Chemically synthesized
uuccaaguagucuagcuu

SEQ ID NO: 9685 - RNA, 18 nt, artificial
  Chemically synthesized
ccaggaugaugucugccu

SEQ ID NO: 9686 - RNA, 18 nt, artificial
  Chemically synthesized
aacaagugauguuugaug

SEQ ID NO: 9687 - RNA, 18 nt, artificial
  Chemically synthesized
ucuccagucuucagguac

SEQ ID NO: 9688 - RNA, 18 nt, artificial
  Chemically synthesized
auacauugcuguuuccug

SEQ ID NO: 9689 - RNA, 18 nt, artificial
  Chemically synthesized
gaaaggguaaaagacuuu

SEQ ID NO: 9690 - RNA, 18 nt, artificial
  Chemically synthesized
ugcuuguaguaucuguug

SEQ ID NO: 9691 - RNA, 18 nt, artificial
  Chemically synthesized
acauuguucuuuuccuga

SEQ ID NO: 9692 - RNA, 18 nt, artificial
  Chemically synthesized
cauuuucccuggugagug

SEQ ID NO: 9693 - RNA, 18 nt, artificial
  Chemically synthesized
caaguuuacagaagcugg

SEQ ID NO: 9694 - RNA, 18 nt, artificial
  Chemically synthesized
agguuguuuaagacgugc

SEQ ID NO: 9695 - RNA, 18 nt, artificial
  Chemically synthesized
gacaaccagccuaaagua

SEQ ID NO: 9696 - RNA, 18 nt, artificial
  Chemically synthesized
gcagggaguauacauugc

SEQ ID NO: 9697 - RNA, 18 nt, artificial
  Chemically synthesized
ucagaugaauaagaccau

SEQ ID NO: 9698 - RNA, 18 nt, artificial
  Chemically synthesized
aucuaccaagccuugagu

SEQ ID NO: 9699 - RNA, 18 nt, artificial
  Chemically synthesized
aaauggaugucuauggcu

SEQ ID NO: 9700 - RNA, 18 nt, artificial
  Chemically synthesized
uacagagacuuuauuccc

SEQ ID NO: 9701 - RNA, 18 nt, artificial
  Chemically synthesized
acuggguguucacuuuuu

SEQ ID NO: 9702 - RNA, 18 nt, artificial
  Chemically synthesized
gguccaacacuuguucag

SEQ ID NO: 9703 - RNA, 18 nt, artificial
  Chemically synthesized
cagagggaauaaaugcua

SEQ ID NO: 9704 - RNA, 18 nt, artificial
  Chemically synthesized
ugaggaugaugccaggau

SEQ ID NO: 9705 - RNA, 18 nt, artificial
  Chemically synthesized
ccuaagccaccucucuac

SEQ ID NO: 9706 - RNA, 18 nt, artificial
  Chemically synthesized
augaguucaaacuucuug

SEQ ID NO: 9707 - RNA, 18 nt, artificial
  Chemically synthesized
gagggaauaaaugcuaga

SEQ ID NO: 9708 - RNA, 18 nt, artificial
  Chemically synthesized
auggcaucuucaauggcu

SEQ ID NO: 9709 - RNA, 18 nt, artificial
  Chemically synthesized
gucgguccucagugugcu

SEQ ID NO: 9710 - RNA, 18 nt, artificial
  Chemically synthesized
gcagcagguggagcugua

SEQ ID NO: 9711 - RNA, 18 nt, artificial
  Chemically synthesized
aacacaugcucacaacca

SEQ ID NO: 9712 - RNA, 18 nt, artificial
  Chemically synthesized
auuaacacaugcucacaa

SEQ ID NO: 9713 - RNA, 18 nt, artificial
  Chemically synthesized
ugcaacaccuucagauaa

SEQ ID NO: 9714 - RNA, 18 nt, artificial
  Chemically synthesized
auaucuucacagagcuga

SEQ ID NO: 9715 - RNA, 18 nt, artificial
  Chemically synthesized
uacagaagcugguggcug

SEQ ID NO: 9716 - RNA, 18 nt, artificial
  Chemically synthesized
cuggaaauaugaccacag

SEQ ID NO: 9717 - RNA, 18 nt, artificial
  Chemically synthesized
cccuguacccuucucacu

SEQ ID NO: 9718 - RNA, 18 nt, artificial
  Chemically synthesized
uggaccucugaaucucuu

SEQ ID NO: 9719 - RNA, 18 nt, artificial
  Chemically synthesized
uauccaaccaggugcauu

SEQ ID NO: 9720 - RNA, 18 nt, artificial
  Chemically synthesized
accaaucuagagcacuug

SEQ ID NO: 9721 - RNA, 18 nt, artificial
  Chemically synthesized
augagauugcucagaccu

SEQ ID NO: 9722 - RNA, 18 nt, artificial
  Chemically synthesized
gcuccugaugcaagaugc

SEQ ID NO: 9723 - RNA, 18 nt, artificial
  Chemically synthesized
guaucuguuguagcaguu

SEQ ID NO: 9724 - RNA, 18 nt, artificial
  Chemically synthesized
cucugucacuuugucacu

SEQ ID NO: 9725 - RNA, 18 nt, artificial
  Chemically synthesized
aauuucggauggcaacau

SEQ ID NO: 9726 - RNA, 18 nt, artificial
  Chemically synthesized
cuagaacaucuggauuuc

SEQ ID NO: 9727 - RNA, 18 nt, artificial
  Chemically synthesized
uacuuagacuacuaccuc

SEQ ID NO: 9728 - RNA, 18 nt, artificial
  Chemically synthesized
aaaggugauuguuguggu

SEQ ID NO: 9729 - RNA, 18 nt, artificial
  Chemically synthesized
caugacaaagaaagucau

SEQ ID NO: 9730 - RNA, 18 nt, artificial
  Chemically synthesized
gcuguaccgccuucucag

SEQ ID NO: 9731 - RNA, 18 nt, artificial
  Chemically synthesized
cauacucacaccagaguu

SEQ ID NO: 9732 - RNA, 18 nt, artificial
  Chemically synthesized
cuaaggaaaccugauuaa

SEQ ID NO: 9733 - RNA, 18 nt, artificial
  Chemically synthesized
cuuagacuacuaccucga

SEQ ID NO: 9734 - RNA, 18 nt, artificial
  Chemically synthesized
cagaaaagcccugcugga

SEQ ID NO: 9735 - RNA, 18 nt, artificial
  Chemically synthesized
ugugcauuugugcacaua

SEQ ID NO: 9736 - RNA, 18 nt, artificial
  Chemically synthesized
uccuuauaagugucugaa

SEQ ID NO: 9737 - RNA, 18 nt, artificial
  Chemically synthesized
uccagguucuugauuaca

SEQ ID NO: 9738 - RNA, 18 nt, artificial
  Chemically synthesized
aaacuuccuuccagauau

SEQ ID NO: 9739 - RNA, 18 nt, artificial
  Chemically synthesized
acaucuggauuuccagca

SEQ ID NO: 9740 - RNA, 18 nt, artificial
  Chemically synthesized
agucuuccaggugggcau

SEQ ID NO: 9741 - RNA, 18 nt, artificial
  Chemically synthesized
gucaacuggagcaguugu

SEQ ID NO: 9742 - RNA, 18 nt, artificial
  Chemically synthesized
cguuugguucugggagaa

SEQ ID NO: 9743 - RNA, 18 nt, artificial
  Chemically synthesized
cuggaccucucucagugu

SEQ ID NO: 9744 - RNA, 18 nt, artificial
  Chemically synthesized
ggaugaugucugccucgc

SEQ ID NO: 9745 - RNA, 18 nt, artificial
  Chemically synthesized
ccuggguguguuuccaug

SEQ ID NO: 9746 - RNA, 18 nt, artificial
  Chemically synthesized
ucagaaugacuuugcuug

SEQ ID NO: 9747 - RNA, 18 nt, artificial
  Chemically synthesized
cuugacauuucucauacu

SEQ ID NO: 9748 - RNA, 18 nt, artificial
  Chemically synthesized
caugccugugcugaguuu

SEQ ID NO: 9749 - RNA, 18 nt, artificial
  Chemically synthesized
gcuggcaauucuuuccag

SEQ ID NO: 9750 - RNA, 18 nt, artificial
  Chemically synthesized
gauaugcagggcugcuaa

SEQ ID NO: 9751 - RNA, 18 nt, artificial
  Chemically synthesized
ucugaccaaucuagagca

SEQ ID NO: 9752 - RNA, 18 nt, artificial
  Chemically synthesized
gaacaacuagaacaucug

SEQ ID NO: 9753 - RNA, 18 nt, artificial
  Chemically synthesized
aauggcuugaguuucaaa

SEQ ID NO: 9754 - RNA, 18 nt, artificial
  Chemically synthesized
aucuuacucagaaugacu

SEQ ID NO: 9755 - RNA, 18 nt, artificial
  Chemically synthesized
guaguaucuguuguagca

SEQ ID NO: 9756 - RNA, 18 nt, artificial
  Chemically synthesized
gugcuuguaguaucuguu

SEQ ID NO: 9757 - RNA, 18 nt, artificial
  Chemically synthesized
agauaucuucacagagcu

SEQ ID NO: 9758 - RNA, 18 nt, artificial
  Chemically synthesized
ucuucaauggcuugucca

SEQ ID NO: 9759 - RNA, 18 nt, artificial
  Chemically synthesized
aacaguggguacaggaug

SEQ ID NO: 9760 - RNA, 18 nt, artificial
  Chemically synthesized
ucuuccaggugggcauuu

SEQ ID NO: 9761 - RNA, 18 nt, artificial
  Chemically synthesized
ucacaaucuuauccaauc

SEQ ID NO: 9762 - RNA, 18 nt, artificial
  Chemically synthesized
ugaacaccagaguuuccu

SEQ ID NO: 9763 - RNA, 18 nt, artificial
  Chemically synthesized
uguggcucacaaucuuau

SEQ ID NO: 9764 - RNA, 18 nt, artificial
  Chemically synthesized
agacacagauggcuggga

SEQ ID NO: 9765 - RNA, 18 nt, artificial
  Chemically synthesized
ugauagcgagccacgcau

SEQ ID NO: 9766 - RNA, 18 nt, artificial
  Chemically synthesized
aauggaaugugcaacacc

SEQ ID NO: 9767 - RNA, 18 nt, artificial
  Chemically synthesized
gaaauuaggcuucauaag

SEQ ID NO: 9768 - RNA, 18 nt, artificial
  Chemically synthesized
ucuuuuccugagucuuuu

SEQ ID NO: 9769 - RNA, 18 nt, artificial
  Chemically synthesized
uccuggucuuaucaugga

SEQ ID NO: 9770 - RNA, 18 nt, artificial
  Chemically synthesized
aacuggguguucacuuuu

SEQ ID NO: 9771 - RNA, 18 nt, artificial
  Chemically synthesized
ccauugcugccaacauca

SEQ ID NO: 9772 - RNA, 18 nt, artificial
  Chemically synthesized
auuuauugcacagacuug

SEQ ID NO: 9773 - RNA, 18 nt, artificial
  Chemically synthesized
cgaauggaaugugcaaca

SEQ ID NO: 9774 - RNA, 18 nt, artificial
  Chemically synthesized
aggaagagaagacaccag

SEQ ID NO: 9775 - RNA, 18 nt, artificial
  Chemically synthesized
ucuugaagaauacaucca

SEQ ID NO: 9776 - RNA, 18 nt, artificial
  Chemically synthesized
aguugaacgaauggaaug

SEQ ID NO: 9777 - RNA, 18 nt, artificial
  Chemically synthesized
guguauuugaaagugugu

SEQ ID NO: 9778 - RNA, 18 nt, artificial
  Chemically synthesized
gauuguugugguguccca

SEQ ID NO: 9779 - RNA, 18 nt, artificial
  Chemically synthesized
caagccaggaugaggacu

SEQ ID NO: 9780 - RNA, 18 nt, artificial
  Chemically synthesized
uaugucugaaugaagcua

SEQ ID NO: 9781 - RNA, 18 nt, artificial
  Chemically synthesized
caccugucagaugaauaa

SEQ ID NO: 9782 - RNA, 18 nt, artificial
  Chemically synthesized
uauggcuguuugagauga

SEQ ID NO: 9783 - RNA, 18 nt, artificial
  Chemically synthesized
cacaacaacuucuuuuca

SEQ ID NO: 9784 - RNA, 18 nt, artificial
  Chemically synthesized
acuaaguaaugacuguca

SEQ ID NO: 9785 - RNA, 18 nt, artificial
  Chemically synthesized
cuucauuuucccugguga

SEQ ID NO: 9786 - RNA, 18 nt, artificial
  Chemically synthesized
gaggcaggaaggaagugg

SEQ ID NO: 9787 - RNA, 18 nt, artificial
  Chemically synthesized
agacgacucagaaaagcc

SEQ ID NO: 9788 - RNA, 18 nt, artificial
  Chemically synthesized
ugguguuauuaccaugag

SEQ ID NO: 9789 - RNA, 18 nt, artificial
  Chemically synthesized
agguucuugauuacaguc

SEQ ID NO: 9790 - RNA, 18 nt, artificial
  Chemically synthesized
cucuuaccucaucaaguu

SEQ ID NO: 9791 - RNA, 18 nt, artificial
  Chemically synthesized
agagccgcugguguaucu

SEQ ID NO: 9792 - RNA, 18 nt, artificial
  Chemically synthesized
uggcaucuucaauggcuu

SEQ ID NO: 9793 - RNA, 18 nt, artificial
  Chemically synthesized
gaugccaggaugaugucu

SEQ ID NO: 9794 - RNA, 18 nt, artificial
  Chemically synthesized
cuuaucauggacaauuug

SEQ ID NO: 9795 - RNA, 18 nt, artificial
  Chemically synthesized
gacaacaaaauucaguug

SEQ ID NO: 9796 - RNA, 18 nt, artificial
  Chemically synthesized
agaguggauguuaucauu

SEQ ID NO: 9797 - RNA, 18 nt, artificial
  Chemically synthesized
cuggcugcauaaaguaug

SEQ ID NO: 9798 - RNA, 18 nt, artificial
  Chemically synthesized
ggugccuccauuucagcu

SEQ ID NO: 9799 - RNA, 18 nt, artificial
  Chemically synthesized
gugauagcgagccacgca

SEQ ID NO: 9800 - RNA, 18 nt, artificial
  Chemically synthesized
acagucucaaucacauaa

SEQ ID NO: 9801 - RNA, 18 nt, artificial
  Chemically synthesized
gucugcaggcguuuucuu

SEQ ID NO: 9802 - RNA, 18 nt, artificial
  Chemically synthesized
gcagugaggaugaugcca

SEQ ID NO: 9803 - RNA, 18 nt, artificial
  Chemically synthesized
ugaaucucuuuagggaga

SEQ ID NO: 9804 - RNA, 18 nt, artificial
  Chemically synthesized
uagugaaaguagaugugu

SEQ ID NO: 9805 - RNA, 18 nt, artificial
  Chemically synthesized
acuugaccuuccuggacc

SEQ ID NO: 9806 - RNA, 18 nt, artificial
  Chemically synthesized
gagauugcucagaccugg

SEQ ID NO: 9807 - RNA, 18 nt, artificial
  Chemically synthesized
aaggaggaagggagaaau

SEQ ID NO: 9808 - RNA, 18 nt, artificial
  Chemically synthesized
uagagaaacaaaagucca

SEQ ID NO: 9809 - RNA, 18 nt, artificial
  Chemically synthesized
aucucuagagaacuuccc

SEQ ID NO: 9810 - RNA, 18 nt, artificial
  Chemically synthesized
ugaacucccuccagguuc

SEQ ID NO: 9811 - RNA, 18 nt, artificial
  Chemically synthesized
cacuuugucacucgaugu

SEQ ID NO: 9812 - RNA, 18 nt, artificial
  Chemically synthesized
uguguuugguuugagcag

SEQ ID NO: 9813 - RNA, 18 nt, artificial
  Chemically synthesized
cucuuuagaccugucccu

SEQ ID NO: 9814 - RNA, 18 nt, artificial
  Chemically synthesized
uguguguccgcaugauca

SEQ ID NO: 9815 - RNA, 18 nt, artificial
  Chemically synthesized
aaagucuaguggcuaauu

SEQ ID NO: 9816 - RNA, 18 nt, artificial
  Chemically synthesized
gaucaaggaccagaggca

SEQ ID NO: 9817 - RNA, 18 nt, artificial
  Chemically synthesized
aaguugaacgaauggaau

SEQ ID NO: 9818 - RNA, 18 nt, artificial
  Chemically synthesized
gaacaucuggauuuccag

SEQ ID NO: 9819 - RNA, 18 nt, artificial
  Chemically synthesized
aaacagaaagagacauug

SEQ ID NO: 9820 - RNA, 18 nt, artificial
  Chemically synthesized
gggccacugcugcucaca

SEQ ID NO: 9821 - RNA, 18 nt, artificial
  Chemically synthesized
gaaacugcucggucagac

SEQ ID NO: 9822 - RNA, 18 nt, artificial
  Chemically synthesized
auguggcucacaaucuua

SEQ ID NO: 9823 - RNA, 18 nt, artificial
  Chemically synthesized
gaguucucuacucuugug

SEQ ID NO: 9824 - RNA, 18 nt, artificial
  Chemically synthesized
ccauuuuaagucugucuc

SEQ ID NO: 9825 - RNA, 18 nt, artificial
  Chemically synthesized
gucugucuccuuacagag

SEQ ID NO: 9826 - RNA, 18 nt, artificial
  Chemically synthesized
acuacgugugaagguauu

SEQ ID NO: 9827 - RNA, 18 nt, artificial
  Chemically synthesized
acaaaggugggaaugcuu

SEQ ID NO: 9828 - RNA, 18 nt, artificial
  Chemically synthesized
caaggaaguauggaaaag

SEQ ID NO: 9829 - RNA, 18 nt, artificial
  Chemically synthesized
gaacccuaugaacuuuau

SEQ ID NO: 9830 - RNA, 18 nt, artificial
  Chemically synthesized
accucugaaucucuuuag

SEQ ID NO: 9831 - RNA, 18 nt, artificial
  Chemically synthesized
ucuucuaacuuccucucc

SEQ ID NO: 9832 - RNA, 18 nt, artificial
  Chemically synthesized
aucucaguagaaauggcu

SEQ ID NO: 9833 - RNA, 18 nt, artificial
  Chemically synthesized
acacaugcucacaaccau

SEQ ID NO: 9834 - RNA, 18 nt, artificial
  Chemically synthesized
augucuauggcuguuuga

SEQ ID NO: 9835 - RNA, 18 nt, artificial
  Chemically synthesized
ucacagagcugagaaacu

SEQ ID NO: 9836 - RNA, 18 nt, artificial
  Chemically synthesized
guggagcuguaccgccuu

SEQ ID NO: 9837 - RNA, 18 nt, artificial
  Chemically synthesized
cucagaaaagcccugcug

SEQ ID NO: 9838 - RNA, 18 nt, artificial
  Chemically synthesized
auccagacaauugaagau

SEQ ID NO: 9839 - RNA, 18 nt, artificial
  Chemically synthesized
auaugagccacaacaacu

SEQ ID NO: 9840 - RNA, 18 nt, artificial
  Chemically synthesized
gugccuccauuucagcuc

SEQ ID NO: 9841 - RNA, 18 nt, artificial
  Chemically synthesized
guguuugguuugagcagg

SEQ ID NO: 9842 - RNA, 18 nt, artificial
  Chemically synthesized
gucccagcacuucaucca

SEQ ID NO: 9843 - RNA, 18 nt, artificial
  Chemically synthesized
acagagacuuuauucccg

SEQ ID NO: 9844 - RNA, 18 nt, artificial
  Chemically synthesized
ggccuuccucuccugcgu

SEQ ID NO: 9845 - RNA, 18 nt, artificial
  Chemically synthesized
ucuugggcuuagaacaac

SEQ ID NO: 9846 - RNA, 18 nt, artificial
  Chemically synthesized
uggagcaguugucuccaa

SEQ ID NO: 9847 - RNA, 18 nt, artificial
  Chemically synthesized
uaaugacugucaugaaag

SEQ ID NO: 9848 - RNA, 18 nt, artificial
  Chemically synthesized
ucaaguuuacagaagcug

SEQ ID NO: 9849 - RNA, 18 nt, artificial
  Chemically synthesized
agugcagagggaauaaau

SEQ ID NO: 9850 - RNA, 18 nt, artificial
  Chemically synthesized
ccugaugcuucuugcugg

SEQ ID NO: 9851 - RNA, 18 nt, artificial
  Chemically synthesized
ucuggcugguuuagaagu

SEQ ID NO: 9852 - RNA, 18 nt, artificial
  Chemically synthesized
ucucuuuagggagacaca

SEQ ID NO: 9853 - RNA, 18 nt, artificial
  Chemically synthesized
ggugucccagcacuucau

SEQ ID NO: 9854 - RNA, 18 nt, artificial
  Chemically synthesized
accugauuaacacaugcu

SEQ ID NO: 9855 - RNA, 18 nt, artificial
  Chemically synthesized
aaaacaaugugucuggaa

SEQ ID NO: 9856 - RNA, 18 nt, artificial
  Chemically synthesized
ucauuguccugcagaagg

SEQ ID NO: 9857 - RNA, 18 nt, artificial
  Chemically synthesized
uccuggaccucucucagu

SEQ ID NO: 9858 - RNA, 18 nt, artificial
  Chemically synthesized
uggacuaucaaguuuaca

SEQ ID NO: 9859 - RNA, 18 nt, artificial
  Chemically synthesized
auugaaaggguaaaagac

SEQ ID NO: 9860 - RNA, 18 nt, artificial
  Chemically synthesized
ucaagaaaaggacaauca

SEQ ID NO: 9861 - RNA, 18 nt, artificial
  Chemically synthesized
acagagucuuccaggugg

SEQ ID NO: 9862 - RNA, 18 nt, artificial
  Chemically synthesized
uccucuccugcgugagac

SEQ ID NO: 9863 - RNA, 18 nt, artificial
  Chemically synthesized
ugcuggaugguaaaucau

SEQ ID NO: 9864 - RNA, 18 nt, artificial
  Chemically synthesized
uucaauggcuuguccagu

SEQ ID NO: 9865 - RNA, 18 nt, artificial
  Chemically synthesized
ugguaucaucuucauugu

SEQ ID NO: 9866 - RNA, 18 nt, artificial
  Chemically synthesized
uucaguauuccuaucacu

SEQ ID NO: 9867 - RNA, 18 nt, artificial
  Chemically synthesized
uuucagaaguugaucuac

SEQ ID NO: 9868 - RNA, 18 nt, artificial
  Chemically synthesized
cucaugaaaugaguugca

SEQ ID NO: 9869 - RNA, 18 nt, artificial
  Chemically synthesized
ucuuacucagaaugacuu

SEQ ID NO: 9870 - RNA, 18 nt, artificial
  Chemically synthesized
acaccuucagauaagcag

SEQ ID NO: 9871 - RNA, 18 nt, artificial
  Chemically synthesized
accagugccucagaaacu

SEQ ID NO: 9872 - RNA, 18 nt, artificial
  Chemically synthesized
uugaaaggguaaaagacu

SEQ ID NO: 9873 - RNA, 18 nt, artificial
  Chemically synthesized
uaguaucuguuguagcag

SEQ ID NO: 9874 - RNA, 18 nt, artificial
  Chemically synthesized
ccagugccucagaaacug

SEQ ID NO: 9875 - RNA, 18 nt, artificial
  Chemically synthesized
gcacuuggaccuuuccag

SEQ ID NO: 9876 - RNA, 18 nt, artificial
  Chemically synthesized
agaaaauuuccgcuuccu

SEQ ID NO: 9877 - RNA, 18 nt, artificial
  Chemically synthesized
ccuuuccagcaacaagau

SEQ ID NO: 9878 - RNA, 18 nt, artificial
  Chemically synthesized
accuccugaggcauuucu

SEQ ID NO: 9879 - RNA, 18 nt, artificial
  Chemically synthesized
ucucaaggagcuuccagu

SEQ ID NO: 9880 - RNA, 18 nt, artificial
  Chemically synthesized
ggaaaaauaaaaaccucc

SEQ ID NO: 9881 - RNA, 18 nt, artificial
  Chemically synthesized
uggaaugugcaacaccuu

SEQ ID NO: 9882 - RNA, 18 nt, artificial
  Chemically synthesized
uagagcacuuggaccuuu

SEQ ID NO: 9883 - RNA, 18 nt, artificial
  Chemically synthesized
augaguucucuacucuug

SEQ ID NO: 9884 - RNA, 18 nt, artificial
  Chemically synthesized
guacacucugucacuuug

SEQ ID NO: 9885 - RNA, 18 nt, artificial
  Chemically synthesized
uggugcacuagauaugca

SEQ ID NO: 9886 - RNA, 18 nt, artificial
  Chemically synthesized
uggugucccagcacuuca

SEQ ID NO: 9887 - RNA, 18 nt, artificial
  Chemically synthesized
auccagccuccucagaaa

SEQ ID NO: 9888 - RNA, 18 nt, artificial
  Chemically synthesized
uucucgagcauguucuau

SEQ ID NO: 9889 - RNA, 18 nt, artificial
  Chemically synthesized
uuuccagcauuccaauuu

SEQ ID NO: 9890 - RNA, 18 nt, artificial
  Chemically synthesized
cucccuccagguucuuga

SEQ ID NO: 9891 - RNA, 18 nt, artificial
  Chemically synthesized
ucuaccaagccuugaguu

SEQ ID NO: 9892 - RNA, 18 nt, artificial
  Chemically synthesized
aggucaccuuuucuugau

SEQ ID NO: 9893 - RNA, 18 nt, artificial
  Chemically synthesized
agagcugagaaacuugac

SEQ ID NO: 9894 - RNA, 18 nt, artificial
  Chemically synthesized
uucuuuuccugagucuuu

SEQ ID NO: 9895 - RNA, 18 nt, artificial
  Chemically synthesized
gugaccucaugaaaugag

SEQ ID NO: 9896 - RNA, 18 nt, artificial
  Chemically synthesized
cugcguggaggugugaaa

SEQ ID NO: 9897 - RNA, 18 nt, artificial
  Chemically synthesized
agguuaaagucuaguggc

SEQ ID NO: 9898 - RNA, 18 nt, artificial
  Chemically synthesized
ggugaccucaugaaauga

SEQ ID NO: 9899 - RNA, 18 nt, artificial
  Chemically synthesized
gcgagccacgcauucaca

SEQ ID NO: 9900 - RNA, 18 nt, artificial
  Chemically synthesized
caaucacauaaugacuuc

SEQ ID NO: 9901 - RNA, 18 nt, artificial
  Chemically synthesized
uguuucagaguguguuug

SEQ ID NO: 9902 - RNA, 18 nt, artificial
  Chemically synthesized
cuuuuucagaaguugauc

SEQ ID NO: 9903 - RNA, 18 nt, artificial
  Chemically synthesized
cuucauccagagccgcug

SEQ ID NO: 9904 - RNA, 18 nt, artificial
  Chemically synthesized
guuuagaaguccaucguu

SEQ ID NO: 9905 - RNA, 18 nt, artificial
  Chemically synthesized
cuuccagauaucuucaca

SEQ ID NO: 9906 - RNA, 18 nt, artificial
  Chemically synthesized
gccuccauuucagcucug

SEQ ID NO: 9907 - RNA, 18 nt, artificial
  Chemically synthesized
caucauuggugugucggu

SEQ ID NO: 9908 - RNA, 18 nt, artificial
  Chemically synthesized
ucuacuugaugacugcag

SEQ ID NO: 9909 - RNA, 18 nt, artificial
  Chemically synthesized
gccucagaaacugcucgg

SEQ ID NO: 9910 - RNA, 18 nt, artificial
  Chemically synthesized
ugaguugcagcagaaguu

SEQ ID NO: 9911 - RNA, 18 nt, artificial
  Chemically synthesized
uccauggugcacuagaua

SEQ ID NO: 9912 - RNA, 18 nt, artificial
  Chemically synthesized
ccuggcugggacucugau

SEQ ID NO: 9913 - RNA, 18 nt, artificial
  Chemically synthesized
caucuucaauggcuuguc

SEQ ID NO: 9914 - RNA, 18 nt, artificial
  Chemically synthesized
cuaaucucaaggagcuuc

SEQ ID NO: 9915 - RNA, 18 nt, artificial
  Chemically synthesized
ugcuaaucucaaggagcu

SEQ ID NO: 9916 - RNA, 18 nt, artificial
  Chemically synthesized
augaccacagucagaagu

SEQ ID NO: 9917 - RNA, 18 nt, artificial
  Chemically synthesized
acaaccagccuaaaguau

SEQ ID NO: 9918 - RNA, 18 nt, artificial
  Chemically synthesized
ccuuccauuuuaagucug

SEQ ID NO: 9919 - RNA, 18 nt, artificial
  Chemically synthesized
gaauuccgauuagcauac

SEQ ID NO: 9920 - RNA, 18 nt, artificial
  Chemically synthesized
caggaacuacagcauuuu

SEQ ID NO: 9921 - RNA, 18 nt, artificial
  Chemically synthesized
gugucgguccucagugug

SEQ ID NO: 9922 - RNA, 18 nt, artificial
  Chemically synthesized
guuugguuugagcagguc

SEQ ID NO: 9923 - RNA, 18 nt, artificial
  Chemically synthesized
aaugcuccuugaccacau

SEQ ID NO: 9924 - RNA, 18 nt, artificial
  Chemically synthesized
cuagaggcaggaaggaag

SEQ ID NO: 9925 - RNA, 18 nt, artificial
  Chemically synthesized
acagcauuuaacucacuc

SEQ ID NO: 9926 - RNA, 18 nt, artificial
  Chemically synthesized
agguggagaagacccugc

SEQ ID NO: 9927 - RNA, 18 nt, artificial
  Chemically synthesized
ugcucagaccuggcaguu

SEQ ID NO: 9928 - RNA, 18 nt, artificial
  Chemically synthesized
cuugccuauaagcuaaua

SEQ ID NO: 9929 - RNA, 18 nt, artificial
  Chemically synthesized
aaucuuacucagaaugac

SEQ ID NO: 9930 - RNA, 18 nt, artificial
  Chemically synthesized
ugaauaucaccugucaga

SEQ ID NO: 9931 - RNA, 18 nt, artificial
  Chemically synthesized
cuaguggcuaauuccuaa

SEQ ID NO: 9932 - RNA, 18 nt, artificial
  Chemically synthesized
gcauaucagagccuaagc

SEQ ID NO: 9933 - RNA, 18 nt, artificial
  Chemically synthesized
cucggucagacggugaua

SEQ ID NO: 9934 - RNA, 18 nt, artificial
  Chemically synthesized
uugugcuuguacaguagu

SEQ ID NO: 9935 - RNA, 18 nt, artificial
  Chemically synthesized
cucuugcuguuucuuuag

SEQ ID NO: 9936 - RNA, 18 nt, artificial
  Chemically synthesized
acaggaacuacagcauuu

SEQ ID NO: 9937 - RNA, 18 nt, artificial
  Chemically synthesized
guugcuuucaauggcauc

SEQ ID NO: 9938 - RNA, 18 nt, artificial
  Chemically synthesized
gauugcucagaccuggca

SEQ ID NO: 9939 - RNA, 18 nt, artificial
  Chemically synthesized
ucucauacucacaccaga

SEQ ID NO: 9940 - RNA, 18 nt, artificial
  Chemically synthesized
cugaacuggguguucacu

SEQ ID NO: 9941 - RNA, 18 nt, artificial
  Chemically synthesized
ugaaaggguaaaagacuu

SEQ ID NO: 9942 - RNA, 18 nt, artificial
  Chemically synthesized
cuuccuggaccucucuca

SEQ ID NO: 9943 - RNA, 18 nt, artificial
  Chemically synthesized
uggcaguuucugagcagu

SEQ ID NO: 9944 - RNA, 18 nt, artificial
  Chemically synthesized
uucaaggcagggaguaua

SEQ ID NO: 9945 - RNA, 18 nt, artificial
  Chemically synthesized
cugggagcccugcgugga

SEQ ID NO: 9946 - RNA, 18 nt, artificial
  Chemically synthesized
agaagcagugaggaugau

SEQ ID NO: 9947 - RNA, 18 nt, artificial
  Chemically synthesized
uugagaugaguucucuac

SEQ ID NO: 9948 - RNA, 18 nt, artificial
  Chemically synthesized
gaacuuuauccaaccagg

SEQ ID NO: 9949 - RNA, 18 nt, artificial
  Chemically synthesized
ucaaggaaguauggaaaa

SEQ ID NO: 9950 - RNA, 18 nt, artificial
  Chemically synthesized
acuaccucgaugauauua

SEQ ID NO: 9951 - RNA, 18 nt, artificial
  Chemically synthesized
cauccagagccgcuggug

SEQ ID NO: 9952 - RNA, 18 nt, artificial
  Chemically synthesized
gaaguguuuguuacugag

SEQ ID NO: 9953 - RNA, 18 nt, artificial
  Chemically synthesized
acuggaaauaugaccaca

SEQ ID NO: 9954 - RNA, 18 nt, artificial
  Chemically synthesized
guuguggugucccagcac

SEQ ID NO: 9955 - RNA, 18 nt, artificial
  Chemically synthesized
gcauaaaguaugguagag

SEQ ID NO: 9956 - RNA, 18 nt, artificial
  Chemically synthesized
uagaacaacuagaacauc

SEQ ID NO: 9957 - RNA, 18 nt, artificial
  Chemically synthesized
ugggcuagaggcaggaag

SEQ ID NO: 9958 - RNA, 18 nt, artificial
  Chemically synthesized
cagacaauugaagauggg

SEQ ID NO: 9959 - RNA, 18 nt, artificial
  Chemically synthesized
cauggugcacuagauaug

SEQ ID NO: 9960 - RNA, 18 nt, artificial
  Chemically synthesized
agguugccgcuuucacuu

SEQ ID NO: 9961 - RNA, 18 nt, artificial
  Chemically synthesized
cuugugcuuguacaguag

SEQ ID NO: 9962 - RNA, 18 nt, artificial
  Chemically synthesized
gaagacaccagugccuca

SEQ ID NO: 9963 - RNA, 18 nt, artificial
  Chemically synthesized
aggaagcaacaucuaucu

SEQ ID NO: 9964 - RNA, 18 nt, artificial
  Chemically synthesized
aaguugaucuaccaagcc

SEQ ID NO: 9965 - RNA, 18 nt, artificial
  Chemically synthesized
aguuugacaaaucugcuc

SEQ ID NO: 9966 - RNA, 18 nt, artificial
  Chemically synthesized
cuaagguugccgcuuuca

SEQ ID NO: 9967 - RNA, 18 nt, artificial
  Chemically synthesized
aucucaaggagcuuccag

SEQ ID NO: 9968 - RNA, 18 nt, artificial
  Chemically synthesized
cauugcugccaacaucau

SEQ ID NO: 9969 - RNA, 18 nt, artificial
  Chemically synthesized
caacuucuuuucauugga

SEQ ID NO: 9970 - RNA, 18 nt, artificial
  Chemically synthesized
acaucuucuggagacgac

SEQ ID NO: 9971 - RNA, 18 nt, artificial
  Chemically synthesized
gcauuugugcacauaucc

SEQ ID NO: 9972 - RNA, 18 nt, artificial
  Chemically synthesized
ugugcuuguaguaucugu

SEQ ID NO: 9973 - RNA, 18 nt, artificial
  Chemically synthesized
ucugaaucucuuuaggga

SEQ ID NO: 9974 - RNA, 18 nt, artificial
  Chemically synthesized
guuuccuguugggcaaug

SEQ ID NO: 9975 - RNA, 18 nt, artificial
  Chemically synthesized
uguccugcagaaggugga

SEQ ID NO: 9976 - RNA, 18 nt, artificial
  Chemically synthesized
gugucugaacucccucca

SEQ ID NO: 9977 - RNA, 18 nt, artificial
  Chemically synthesized
guugaacgaauggaaugu

SEQ ID NO: 9978 - RNA, 18 nt, artificial
  Chemically synthesized
gaaaacuuguauucaagg

SEQ ID NO: 9979 - RNA, 18 nt, artificial
  Chemically synthesized
gccaacaucauccaugaa

SEQ ID NO: 9980 - RNA, 18 nt, artificial
  Chemically synthesized
aaaucauggaauccagaa

SEQ ID NO: 9981 - RNA, 18 nt, artificial
  Chemically synthesized
ucacuuugucacucgaug

SEQ ID NO: 9982 - RNA, 18 nt, artificial
  Chemically synthesized
ugagcaggucuaggguga

SEQ ID NO: 9983 - RNA, 18 nt, artificial
  Chemically synthesized
aguuuacagaagcuggug

SEQ ID NO: 9984 - RNA, 18 nt, artificial
  Chemically synthesized
uccagauaucuucacaga

SEQ ID NO: 9985 - RNA, 18 nt, artificial
  Chemically synthesized
ggaauccagaaggaacag

SEQ ID NO: 9986 - RNA, 18 nt, artificial
  Chemically synthesized
aaagaauguucauccagc

SEQ ID NO: 9987 - RNA, 18 nt, artificial
  Chemically synthesized
ccucaggaggucaccuuu

SEQ ID NO: 9988 - RNA, 18 nt, artificial
  Chemically synthesized
gaggucaccuuuucuuga

SEQ ID NO: 9989 - RNA, 18 nt, artificial
  Chemically synthesized
gaucucaguagaaauggc

SEQ ID NO: 9990 - RNA, 18 nt, artificial
  Chemically synthesized
caauuugggcuagaggca

SEQ ID NO: 9991 - RNA, 18 nt, artificial
  Chemically synthesized
gucuuccaggugggcauu

SEQ ID NO: 9992 - RNA, 18 nt, artificial
  Chemically synthesized
gaaaaguacacucuguca

SEQ ID NO: 9993 - RNA, 18 nt, artificial
  Chemically synthesized
uguguguauuugaaagug

SEQ ID NO: 9994 - RNA, 18 nt, artificial
  Chemically synthesized
aggaccagaggcagcucu

SEQ ID NO: 9995 - RNA, 18 nt, artificial
  Chemically synthesized
ugauuuugggacaaccag

SEQ ID NO: 9996 - RNA, 18 nt, artificial
  Chemically synthesized
ccagcacuucauccagag

SEQ ID NO: 9997 - RNA, 18 nt, artificial
  Chemically synthesized
gcugccaacaucauccau

SEQ ID NO: 9998 - RNA, 18 nt, artificial
  Chemically synthesized
augugcaacaccuucaga

SEQ ID NO: 9999 - RNA, 18 nt, artificial
  Chemically synthesized
acucagaaugacuuugcu

SEQ ID NO: 10000 - RNA, 18 nt, artificial
  Chemically synthesized
aacucuuaccucaucaag

SEQ ID NO: 10001 - RNA, 18 nt, artificial
  Chemically synthesized
ugguuuagaaguccaucg

SEQ ID NO: 10002 - RNA, 18 nt, artificial
  Chemically synthesized
cagaaaccucauuuaccu

SEQ ID NO: 10003 - RNA, 18 nt, artificial
  Chemically synthesized
cuuguccagucucgaagu

SEQ ID NO: 10004 - RNA, 18 nt, artificial
  Chemically synthesized
gaugaugccaggaugaug

SEQ ID NO: 10005 - RNA, 18 nt, artificial
  Chemically synthesized
gaugugugcauuugugca

SEQ ID NO: 10006 - RNA, 18 nt, artificial
  Chemically synthesized
cuuccauuuuaagucugu

SEQ ID NO: 10007 - RNA, 18 nt, artificial
  Chemically synthesized
uccucagaaacagaacau

SEQ ID NO: 10008 - RNA, 18 nt, artificial
  Chemically synthesized
auggaaaaguacacucug

SEQ ID NO: 10009 - RNA, 18 nt, artificial
  Chemically synthesized
gaccacauuuugggaaga

SEQ ID NO: 10010 - RNA, 18 nt, artificial
  Chemically synthesized
agaaacaaaaguccagaa

SEQ ID NO: 10011 - RNA, 18 nt, artificial
  Chemically synthesized
caucccuggguguguuuc

SEQ ID NO: 10012 - RNA, 18 nt, artificial
  Chemically synthesized
uuggacaucucaaaacuu

SEQ ID NO: 10013 - RNA, 18 nt, artificial
  Chemically synthesized
cacuuaccuggaguggga

SEQ ID NO: 10014 - RNA, 18 nt, artificial
  Chemically synthesized
cugcuggaugguaaauca

SEQ ID NO: 10015 - RNA, 18 nt, artificial
  Chemically synthesized
aguccaucguuugguucu

SEQ ID NO: 10016 - RNA, 18 nt, artificial
  Chemically synthesized
cuggguguucacuuuuuc

SEQ ID NO: 10017 - RNA, 18 nt, artificial
  Chemically synthesized
ucuucuggagacgacuca

SEQ ID NO: 10018 - RNA, 18 nt, artificial
  Chemically synthesized
guggcucacaaucuuauc

SEQ ID NO: 10019 - RNA, 18 nt, artificial
  Chemically synthesized
acaucuaugaugccuuug

SEQ ID NO: 10020 - RNA, 18 nt, artificial
  Chemically synthesized
uggguacaggaugcaauu

SEQ ID NO: 10021 - RNA, 18 nt, artificial
  Chemically synthesized
ucuacucuugugcuugua

SEQ ID NO: 10022 - RNA, 18 nt, artificial
  Chemically synthesized
caggaacacuuaccugga

SEQ ID NO: 10023 - RNA, 18 nt, artificial
  Chemically synthesized
aauaugagauugcucaga

SEQ ID NO: 10024 - RNA, 18 nt, artificial
  Chemically synthesized
auuggacaucucaaaacu

SEQ ID NO: 10025 - RNA, 18 nt, artificial
  Chemically synthesized
aaaggcuuacuuucacuu

SEQ ID NO: 10026 - RNA, 18 nt, artificial
  Chemically synthesized
aauuccgauuagcauacu

SEQ ID NO: 10027 - RNA, 18 nt, artificial
  Chemically synthesized
cucgaugauauuauugac

SEQ ID NO: 10028 - RNA, 18 nt, artificial
  Chemically synthesized
cucaagccaggaugagga

SEQ ID NO: 10029 - RNA, 18 nt, artificial
  Chemically synthesized
ucuccaacagcauuuaac

SEQ ID NO: 10030 - RNA, 18 nt, artificial
  Chemically synthesized
cuucucagcaggaacacu

SEQ ID NO: 10031 - RNA, 18 nt, artificial
  Chemically synthesized
caggccuuaugcuaaggg

SEQ ID NO: 10032 - RNA, 18 nt, artificial
  Chemically synthesized
aaaguagaugugugcauu

SEQ ID NO: 10033 - RNA, 18 nt, artificial
  Chemically synthesized
agcugggagcccugcgug

SEQ ID NO: 10034 - RNA, 18 nt, artificial
  Chemically synthesized
uguguguguccgcaugau

SEQ ID NO: 10035 - RNA, 18 nt, artificial
  Chemically synthesized
gcugggacucugauccca

SEQ ID NO: 10036 - RNA, 18 nt, artificial
  Chemically synthesized
acuugaugacugcagucg

SEQ ID NO: 10037 - RNA, 18 nt, artificial
  Chemically synthesized
guuuacagaagcuggugg

SEQ ID NO: 10038 - RNA, 18 nt, artificial
  Chemically synthesized
gccacuggucugcaggcg

SEQ ID NO: 10039 - RNA, 18 nt, artificial
  Chemically synthesized
gaaaaggacaaucaggau

SEQ ID NO: 10040 - RNA, 18 nt, artificial
  Chemically synthesized
auuccuaaggaaaccuga

SEQ ID NO: 10041 - RNA, 18 nt, artificial
  Chemically synthesized
ugaggaaauagggaguug

SEQ ID NO: 10042 - RNA, 18 nt, artificial
  Chemically synthesized
cuggagugggaggacagu

SEQ ID NO: 10043 - RNA, 18 nt, artificial
  Chemically synthesized
aucagggcuguguguauu

SEQ ID NO: 10044 - RNA, 18 nt, artificial
  Chemically synthesized
aaugaguugcagcagaag

SEQ ID NO: 10045 - RNA, 18 nt, artificial
  Chemically synthesized
auggaccucugaaucucu

SEQ ID NO: 10046 - RNA, 18 nt, artificial
  Chemically synthesized
cucugccuucacuacaga

SEQ ID NO: 10047 - RNA, 18 nt, artificial
  Chemically synthesized
gcagcucuugguggaagu

SEQ ID NO: 10048 - RNA, 18 nt, artificial
  Chemically synthesized
gaaguugaucuaccaagc

SEQ ID NO: 10049 - RNA, 18 nt, artificial
  Chemically synthesized
gucaccuuuucuugauuc

SEQ ID NO: 10050 - RNA, 18 nt, artificial
  Chemically synthesized
aaaugaguugcagcagaa

SEQ ID NO: 10051 - RNA, 18 nt, artificial
  Chemically synthesized
auggaaugugcaacaccu

SEQ ID NO: 10052 - RNA, 18 nt, artificial
  Chemically synthesized
aaucugaccaaucuagag

SEQ ID NO: 10053 - RNA, 18 nt, artificial
  Chemically synthesized
gagaagacccugcucagg

SEQ ID NO: 10054 - RNA, 18 nt, artificial
  Chemically synthesized
gggaugaccucaggaggu

SEQ ID NO: 10055 - RNA, 18 nt, artificial
  Chemically synthesized
gaccuuccuggaccucuc

SEQ ID NO: 10056 - RNA, 18 nt, artificial
  Chemically synthesized
gugggaugaccucaggag

SEQ ID NO: 10057 - RNA, 18 nt, artificial
  Chemically synthesized
guacuagugaaaguagau

SEQ ID NO: 10058 - RNA, 18 nt, artificial
  Chemically synthesized
accagccuaaaguauuua

SEQ ID NO: 10059 - RNA, 18 nt, artificial
  Chemically synthesized
gcccagcuggguccaaca

SEQ ID NO: 10060 - RNA, 18 nt, artificial
  Chemically synthesized
ugucacuuugucacucga

SEQ ID NO: 10061 - RNA, 18 nt, artificial
  Chemically synthesized
accuggagugggaggaca

SEQ ID NO: 10062 - RNA, 18 nt, artificial
  Chemically synthesized
uccaaaaaacaggaacua

SEQ ID NO: 10063 - RNA, 18 nt, artificial
  Chemically synthesized
gcaggcguuuucuucuuc

SEQ ID NO: 10064 - RNA, 18 nt, artificial
  Chemically synthesized
gucuugccuauaagcuaa

SEQ ID NO: 10065 - RNA, 18 nt, artificial
  Chemically synthesized
cuccugaggcauuucuug

SEQ ID NO: 10066 - RNA, 18 nt, artificial
  Chemically synthesized
ucacuuccaacaaaggug

SEQ ID NO: 10067 - RNA, 18 nt, artificial
  Chemically synthesized
ugaguguuucagagugug

SEQ ID NO: 10068 - RNA, 18 nt, artificial
  Chemically synthesized
acgugcuucaaauaucca

SEQ ID NO: 10069 - RNA, 18 nt, artificial
  Chemically synthesized
agugaaaguagaugugug

SEQ ID NO: 10070 - RNA, 18 nt, artificial
  Chemically synthesized
gcaauggaucaaggacca

SEQ ID NO: 10071 - RNA, 18 nt, artificial
  Chemically synthesized
augacuuugcuuguacuu

SEQ ID NO: 10072 - RNA, 18 nt, artificial
  Chemically synthesized
acuucauccagagccgcu

SEQ ID NO: 10073 - RNA, 18 nt, artificial
  Chemically synthesized
caggaaaacuuccuucca

SEQ ID NO: 10074 - RNA, 18 nt, artificial
  Chemically synthesized
cugccaggagaacuacgu

SEQ ID NO: 10075 - RNA, 18 nt, artificial
  Chemically synthesized
ccuuccucuccugcguga

SEQ ID NO: 10076 - RNA, 18 nt, artificial
  Chemically synthesized
ucgaugucauuccaaagu

SEQ ID NO: 10077 - RNA, 18 nt, artificial
  Chemically synthesized
ugaagguuuccauaaaag

SEQ ID NO: 10078 - RNA, 18 nt, artificial
  Chemically synthesized
gucauuucaacucuuacc

SEQ ID NO: 10079 - RNA, 18 nt, artificial
  Chemically synthesized
gugauguuugauggaccu

SEQ ID NO: 10080 - RNA, 18 nt, artificial
  Chemically synthesized
cgagccacgcauucacag

SEQ ID NO: 10081 - RNA, 18 nt, artificial
  Chemically synthesized
guauggaaaaguacacuc

SEQ ID NO: 10082 - RNA, 18 nt, artificial
  Chemically synthesized
ucaugaaaugaguugcag

SEQ ID NO: 10083 - RNA, 18 nt, artificial
  Chemically synthesized
ucgaggaagagaagacac

SEQ ID NO: 10084 - RNA, 18 nt, artificial
  Chemically synthesized
caugcucacaaccauccu

SEQ ID NO: 10085 - RNA, 18 nt, artificial
  Chemically synthesized
gacucagaaaagcccugc

SEQ ID NO: 10086 - RNA, 18 nt, artificial
  Chemically synthesized
aacaaaggugggaaugcu

SEQ ID NO: 10087 - RNA, 18 nt, artificial
  Chemically synthesized
cucaaagugauuuuggga

SEQ ID NO: 10088 - RNA, 18 nt, artificial
  Chemically synthesized
cacuucauccagagccgc

SEQ ID NO: 10089 - RNA, 18 nt, artificial
  Chemically synthesized
guaccgccuucucagcag

SEQ ID NO: 10090 - RNA, 18 nt, artificial
  Chemically synthesized
uguaccgccuucucagca

SEQ ID NO: 10091 - RNA, 18 nt, artificial
  Chemically synthesized
ucucaaucacauaaugac

SEQ ID NO: 10092 - RNA, 18 nt, artificial
  Chemically synthesized
ucucgaagucuugaaaau

SEQ ID NO: 10093 - RNA, 18 nt, artificial
  Chemically synthesized
ccauggccuuccucuccu

SEQ ID NO: 10094 - RNA, 18 nt, artificial
  Chemically synthesized
cuugaugacugcagucgu

SEQ ID NO: 10095 - RNA, 18 nt, artificial
  Chemically synthesized
ucaaaucucucaaaaggc

SEQ ID NO: 10096 - RNA, 18 nt, artificial
  Chemically synthesized
ugcugguaucaucuucau

SEQ ID NO: 10097 - RNA, 18 nt, artificial
  Chemically synthesized
gcacuucauccagagccg

SEQ ID NO: 10098 - RNA, 18 nt, artificial
  Chemically synthesized
gucauucucgagcauguu

SEQ ID NO: 10099 - RNA, 18 nt, artificial
  Chemically synthesized
gugucuggaauuaauggg

SEQ ID NO: 10100 - RNA, 18 nt, artificial
  Chemically synthesized
cacauugaaacucaaauc

SEQ ID NO: 10101 - RNA, 18 nt, artificial
  Chemically synthesized
auuugaaagugugugugu

SEQ ID NO: 10102 - RNA, 18 nt, artificial
  Chemically synthesized
aaaacaucuaugaugccu

SEQ ID NO: 10103 - RNA, 18 nt, artificial
  Chemically synthesized
uuuccugagucuuuugaa

SEQ ID NO: 10104 - RNA, 18 nt, artificial
  Chemically synthesized
ugaaggaaacuuggaaaa

SEQ ID NO: 10105 - RNA, 18 nt, artificial
  Chemically synthesized
uacagagucuuccaggug

SEQ ID NO: 10106 - RNA, 18 nt, artificial
  Chemically synthesized
caauucuuuccaggaaaa

SEQ ID NO: 10107 - RNA, 18 nt, artificial
  Chemically synthesized
cugggacucugaucccag

SEQ ID NO: 10108 - RNA, 18 nt, artificial
  Chemically synthesized
agaaguccaucguuuggu

SEQ ID NO: 10109 - RNA, 18 nt, artificial
  Chemically synthesized
auucuuuccaggaaaacu

SEQ ID NO: 10110 - RNA, 18 nt, artificial
  Chemically synthesized
uaagccaccucucuaccu

SEQ ID NO: 10111 - RNA, 18 nt, artificial
  Chemically synthesized
ugcucuagagggccugug

SEQ ID NO: 10112 - RNA, 18 nt, artificial
  Chemically synthesized
agggaauaaaugcuagac

SEQ ID NO: 10113 - RNA, 18 nt, artificial
  Chemically synthesized
caacaucauccaugaagg

SEQ ID NO: 10114 - RNA, 18 nt, artificial
  Chemically synthesized
aauggaugucuauggcug

SEQ ID NO: 10115 - RNA, 18 nt, artificial
  Chemically synthesized
uuucagaacaagugaugu

SEQ ID NO: 10116 - RNA, 18 nt, artificial
  Chemically synthesized
acuuccuuccagauaucu

SEQ ID NO: 10117 - RNA, 18 nt, artificial
  Chemically synthesized
ccaaucuuucaaauuacc

SEQ ID NO: 10118 - RNA, 18 nt, artificial
  Chemically synthesized
agaaaccucauuuaccuu

SEQ ID NO: 10119 - RNA, 18 nt, artificial
  Chemically synthesized
ggcaucuucaauggcuug

SEQ ID NO: 10120 - RNA, 18 nt, artificial
  Chemically synthesized
ugcuggcugcauaaagua

SEQ ID NO: 10121 - RNA, 18 nt, artificial
  Chemically synthesized
acuuccucucacccuuua

SEQ ID NO: 10122 - RNA, 18 nt, artificial
  Chemically synthesized
cagugucaacuggagcag

SEQ ID NO: 10123 - RNA, 18 nt, artificial
  Chemically synthesized
agccacgcauucacaggg

SEQ ID NO: 10124 - RNA, 18 nt, artificial
  Chemically synthesized
ccuccauuucagcucugc

SEQ ID NO: 10125 - RNA, 18 nt, artificial
  Chemically synthesized
ugccuccauuucagcucu

SEQ ID NO: 10126 - RNA, 18 nt, artificial
  Chemically synthesized
uacagagguuaaagucua

SEQ ID NO: 10127 - RNA, 18 nt, artificial
  Chemically synthesized
acaaaucugcucuagagg

SEQ ID NO: 10128 - RNA, 18 nt, artificial
  Chemically synthesized
uccagagccgcuggugua

SEQ ID NO: 10129 - RNA, 18 nt, artificial
  Chemically synthesized
augguagaggugaaaaca

SEQ ID NO: 10130 - RNA, 18 nt, artificial
  Chemically synthesized
aacgaauggaaugugcaa

SEQ ID NO: 10131 - RNA, 18 nt, artificial
  Chemically synthesized
aagguuguuuaagacgug

SEQ ID NO: 10132 - RNA, 18 nt, artificial
  Chemically synthesized
agcuggguccaacacuug

SEQ ID NO: 10133 - RNA, 18 nt, artificial
  Chemically synthesized
ugaugcuucuugcuggcu

SEQ ID NO: 10134 - RNA, 18 nt, artificial
  Chemically synthesized
gucugaacucccuccagg

SEQ ID NO: 10135 - RNA, 18 nt, artificial
  Chemically synthesized
uguguccgcaugaucaua

SEQ ID NO: 10136 - RNA, 18 nt, artificial
  Chemically synthesized
acauugcuguuuccuguu

SEQ ID NO: 10137 - RNA, 18 nt, artificial
  Chemically synthesized
agguggagcuguaccgcc

SEQ ID NO: 10138 - RNA, 18 nt, artificial
  Chemically synthesized
uuuggacaguuucccaca

SEQ ID NO: 10139 - RNA, 18 nt, artificial
  Chemically synthesized
ucuaacuuccucuccugu

SEQ ID NO: 10140 - RNA, 18 nt, artificial
  Chemically synthesized
uucucuacucuugugcuu

SEQ ID NO: 10141 - RNA, 18 nt, artificial
  Chemically synthesized
ucagaaaccucauuuacc

SEQ ID NO: 10142 - RNA, 18 nt, artificial
  Chemically synthesized
ugugcuuguacaguaguc

SEQ ID NO: 10143 - RNA, 18 nt, artificial
  Chemically synthesized
cauuuuuuuacgucuugc

SEQ ID NO: 10144 - RNA, 18 nt, artificial
  Chemically synthesized
cuagacuaaaauacagag

SEQ ID NO: 10145 - RNA, 18 nt, artificial
  Chemically synthesized
aauaagaccaucauuggu

SEQ ID NO: 10146 - RNA, 18 nt, artificial
  Chemically synthesized
ggagacacagauggcugg

SEQ ID NO: 10147 - RNA, 18 nt, artificial
  Chemically synthesized
uuugacaaaucugcucua

SEQ ID NO: 10148 - RNA, 18 nt, artificial
  Chemically synthesized
aacuucuugggcuuagaa

SEQ ID NO: 10149 - RNA, 18 nt, artificial
  Chemically synthesized
aggcagcucuugguggaa

SEQ ID NO: 10150 - RNA, 18 nt, artificial
  Chemically synthesized
ugucaacuggagcaguug

SEQ ID NO: 10151 - RNA, 18 nt, artificial
  Chemically synthesized
agagcacuuggaccuuuc

SEQ ID NO: 10152 - RNA, 18 nt, artificial
  Chemically synthesized
uucagaguguguuugguu

SEQ ID NO: 10153 - RNA, 18 nt, artificial
  Chemically synthesized
accacauuuugggaagag

SEQ ID NO: 10154 - RNA, 18 nt, artificial
  Chemically synthesized
augacugucaugaaagca

SEQ ID NO: 10155 - RNA, 18 nt, artificial
  Chemically synthesized
aauaugagccacaacaac

SEQ ID NO: 10156 - RNA, 18 nt, artificial
  Chemically synthesized
gagguuaaagucuagugg

SEQ ID NO: 10157 - RNA, 18 nt, artificial
  Chemically synthesized
augacuuccaaaaaacag

SEQ ID NO: 10158 - RNA, 18 nt, artificial
  Chemically synthesized
uggagugggaggacagug

SEQ ID NO: 10159 - RNA, 18 nt, artificial
  Chemically synthesized
aaguuugacaaaucugcu

SEQ ID NO: 10160 - RNA, 18 nt, artificial
  Chemically synthesized
uaucccuauguaucccua

SEQ ID NO: 10161 - RNA, 18 nt, artificial
  Chemically synthesized
gccuucucagcaggaaca

SEQ ID NO: 10162 - RNA, 18 nt, artificial
  Chemically synthesized
aucuagagcacuuggacc

SEQ ID NO: 10163 - RNA, 18 nt, artificial
  Chemically synthesized
cuggucauucucgagcau

SEQ ID NO: 10164 - RNA, 18 nt, artificial
  Chemically synthesized
ucccuaucagggcugugu

SEQ ID NO: 10165 - RNA, 18 nt, artificial
  Chemically synthesized
cagagguuaaagucuagu

SEQ ID NO: 10166 - RNA, 18 nt, artificial
  Chemically synthesized
cucaggaggucaccuuuu

SEQ ID NO: 10167 - RNA, 18 nt, artificial
  Chemically synthesized
agagggccugugcaauuu

SEQ ID NO: 10168 - RNA, 18 nt, artificial
  Chemically synthesized
gagcuuccagugcagagg

SEQ ID NO: 10169 - RNA, 18 nt, artificial
  Chemically synthesized
uuagcauacuuagacuac

SEQ ID NO: 10170 - RNA, 18 nt, artificial
  Chemically synthesized
ugauguuugauggaccuc

SEQ ID NO: 10171 - RNA, 18 nt, artificial
  Chemically synthesized
ugcugcucacagaagcag

SEQ ID NO: 10172 - RNA, 18 nt, artificial
  Chemically synthesized
cucugaucccagccaugg

SEQ ID NO: 10173 - RNA, 18 nt, artificial
  Chemically synthesized
auggcuguuugagaugag

SEQ ID NO: 10174 - RNA, 18 nt, artificial
  Chemically synthesized
ugcguggaggugugaaau

SEQ ID NO: 10175 - RNA, 18 nt, artificial
  Chemically synthesized
guucuacaucaaaugccc

SEQ ID NO: 10176 - RNA, 18 nt, artificial
  Chemically synthesized
cccauccagaguuuagcc

SEQ ID NO: 10177 - RNA, 18 nt, artificial
  Chemically synthesized
ucuaugaugccuuuguua

SEQ ID NO: 10178 - RNA, 18 nt, artificial
  Chemically synthesized
aaguacacucugucacuu

SEQ ID NO: 10179 - RNA, 18 nt, artificial
  Chemically synthesized
acuuuauccaaccaggug

SEQ ID NO: 10180 - RNA, 18 nt, artificial
  Chemically synthesized
aauuaggcuucauaagcu

SEQ ID NO: 10181 - RNA, 18 nt, artificial
  Chemically synthesized
agauggcugggaucccuc

SEQ ID NO: 10182 - RNA, 18 nt, artificial
  Chemically synthesized
aauccagaaggaacagug

SEQ ID NO: 10183 - RNA, 18 nt, artificial
  Chemically synthesized
ucucauguacuagugaaa

SEQ ID NO: 10184 - RNA, 18 nt, artificial
  Chemically synthesized
ugaaaauggcuggcaauu

SEQ ID NO: 10185 - RNA, 18 nt, artificial
  Chemically synthesized
ggagcccugcguggaggu

SEQ ID NO: 10186 - RNA, 18 nt, artificial
  Chemically synthesized
cuauuuucaccugaugcu

SEQ ID NO: 10187 - RNA, 18 nt, artificial
  Chemically synthesized
guauuaaaugcugccaca

SEQ ID NO: 10188 - RNA, 18 nt, artificial
  Chemically synthesized
acuacagcauuuuccaag

SEQ ID NO: 10189 - RNA, 18 nt, artificial
  Chemically synthesized
cuaagccaccucucuacc

SEQ ID NO: 10190 - RNA, 18 nt, artificial
  Chemically synthesized
uuugcuuguacuugugaa

SEQ ID NO: 10191 - RNA, 18 nt, artificial
  Chemically synthesized
ugcauuugugcacauauc

SEQ ID NO: 10192 - RNA, 18 nt, artificial
  Chemically synthesized
ugggacaaccagccuaaa

SEQ ID NO: 10193 - RNA, 18 nt, artificial
  Chemically synthesized
auguaucccuaucagggc

SEQ ID NO: 10194 - RNA, 18 nt, artificial
  Chemically synthesized
uauacauugcuguuuccu

SEQ ID NO: 10195 - RNA, 18 nt, artificial
  Chemically synthesized
gcauuucuugcccagcug

SEQ ID NO: 10196 - RNA, 18 nt, artificial
  Chemically synthesized
cacugccaggagaacuac

SEQ ID NO: 10197 - RNA, 18 nt, artificial
  Chemically synthesized
aaccauccuggucauucu

SEQ ID NO: 10198 - RNA, 18 nt, artificial
  Chemically synthesized
aaucuagagcacuuggac

SEQ ID NO: 10199 - RNA, 18 nt, artificial
  Chemically synthesized
acagagaaaacagaaaga

SEQ ID NO: 10200 - RNA, 18 nt, artificial
  Chemically synthesized
cauuugugcacauauccc

SEQ ID NO: 10201 - RNA, 18 nt, artificial
  Chemically synthesized
guuugagcaggucuaggg

SEQ ID NO: 10202 - RNA, 18 nt, artificial
  Chemically synthesized
uuccugagucuuuugaau

SEQ ID NO: 10203 - RNA, 18 nt, artificial
  Chemically synthesized
guaucccuaucagggcug

SEQ ID NO: 10204 - RNA, 18 nt, artificial
  Chemically synthesized
ugagcuucaaugguguua

SEQ ID NO: 10205 - RNA, 18 nt, artificial
  Chemically synthesized
acuggucugcaggcguuu

SEQ ID NO: 10206 - RNA, 18 nt, artificial
  Chemically synthesized
cccugcuggaugguaaau

SEQ ID NO: 10207 - RNA, 18 nt, artificial
  Chemically synthesized
uaacucacucuccagucu

SEQ ID NO: 10208 - RNA, 18 nt, artificial
  Chemically synthesized
aggcuucauaagcugacu

SEQ ID NO: 10209 - RNA, 18 nt, artificial
  Chemically synthesized
cucauacucacaccagag

SEQ ID NO: 10210 - RNA, 18 nt, artificial
  Chemically synthesized
uacucaagccaggaugag

SEQ ID NO: 10211 - RNA, 18 nt, artificial
  Chemically synthesized
auggaugucuauggcugu

SEQ ID NO: 10212 - RNA, 18 nt, artificial
  Chemically synthesized
gggagcccugcguggagg

SEQ ID NO: 10213 - RNA, 18 nt, artificial
  Chemically synthesized
uuggacaguuucccacau

SEQ ID NO: 10214 - RNA, 18 nt, artificial
  Chemically synthesized
cagauggcugggaucccu

SEQ ID NO: 10215 - RNA, 18 nt, artificial
  Chemically synthesized
gacgacucagaaaagccc

SEQ ID NO: 10216 - RNA, 18 nt, artificial
  Chemically synthesized
auacuuagacuacuaccu

SEQ ID NO: 10217 - RNA, 18 nt, artificial
  Chemically synthesized
aacauaugggcugauaaa

SEQ ID NO: 10218 - RNA, 18 nt, artificial
  Chemically synthesized
agggcugcuaaucucaag

SEQ ID NO: 10219 - RNA, 18 nt, artificial
  Chemically synthesized
gggugccuccauuucagc

SEQ ID NO: 10220 - RNA, 18 nt, artificial
  Chemically synthesized
acuuguauucaaggucug

SEQ ID NO: 10221 - RNA, 18 nt, artificial
  Chemically synthesized
guauuugaaagugugugu

SEQ ID NO: 10222 - RNA, 18 nt, artificial
  Chemically synthesized
ugaaagaacuuaaugugg

SEQ ID NO: 10223 - RNA, 18 nt, artificial
  Chemically synthesized
cgggaagaaaauuuccgc

SEQ ID NO: 10224 - RNA, 18 nt, artificial
  Chemically synthesized
uguuuccuguugggcaau

SEQ ID NO: 10225 - RNA, 18 nt, artificial
  Chemically synthesized
uagcgagccacgcauuca

SEQ ID NO: 10226 - RNA, 18 nt, artificial
  Chemically synthesized
cauuuugguaguuuugac

SEQ ID NO: 10227 - RNA, 18 nt, artificial
  Chemically synthesized
ccuucucagcaggaacac

SEQ ID NO: 10228 - RNA, 18 nt, artificial
  Chemically synthesized
ccucugaaucucuuuagg

SEQ ID NO: 10229 - RNA, 18 nt, artificial
  Chemically synthesized
gccacgcauucacagggc

SEQ ID NO: 10230 - RNA, 18 nt, artificial
  Chemically synthesized
uguauucaaggucuggcu

SEQ ID NO: 10231 - RNA, 18 nt, artificial
  Chemically synthesized
guggaaguugaacgaaug

SEQ ID NO: 10232 - RNA, 18 nt, artificial
  Chemically synthesized
gaagacccugcucaggca

SEQ ID NO: 10233 - RNA, 18 nt, artificial
  Chemically synthesized
cuaaaauacagagucuuc

SEQ ID NO: 10234 - RNA, 18 nt, artificial
  Chemically synthesized
gaccagaggcagcucuug

SEQ ID NO: 10235 - RNA, 18 nt, artificial
  Chemically synthesized
aaaauggcuggcaauucu

SEQ ID NO: 10236 - RNA, 18 nt, artificial
  Chemically synthesized
uucuugggcuuagaacaa

SEQ ID NO: 10237 - RNA, 18 nt, artificial
  Chemically synthesized
uguauuugaaagugugug

SEQ ID NO: 10238 - RNA, 18 nt, artificial
  Chemically synthesized
cucgaugucauuccaaag

SEQ ID NO: 10239 - RNA, 18 nt, artificial
  Chemically synthesized
aucugagcuucaauggug

SEQ ID NO: 10240 - RNA, 18 nt, artificial
  Chemically synthesized
aauggcuuguccagucuc

SEQ ID NO: 10241 - RNA, 18 nt, artificial
  Chemically synthesized
acauccauuugaaaugga

SEQ ID NO: 10242 - RNA, 18 nt, artificial
  Chemically synthesized
gaccucaugaaaugaguu

SEQ ID NO: 10243 - RNA, 18 nt, artificial
  Chemically synthesized
accucaugaaaugaguug

SEQ ID NO: 10244 - RNA, 18 nt, artificial
  Chemically synthesized
cggugauagcgagccacg

SEQ ID NO: 10245 - RNA, 18 nt, artificial
  Chemically synthesized
cguuuccuuauaaguguc

SEQ ID NO: 10246 - RNA, 18 nt, artificial
  Chemically synthesized
gaacaccagaguuuccug

SEQ ID NO: 10247 - RNA, 18 nt, artificial
  Chemically synthesized
aaaccucauuuaccuuga

SEQ ID NO: 10248 - RNA, 18 nt, artificial
  Chemically synthesized
cuagagggccugugcaau

SEQ ID NO: 10249 - RNA, 18 nt, artificial
  Chemically synthesized
aaauagggaguugucuaa

SEQ ID NO: 10250 - RNA, 18 nt, artificial
  Chemically synthesized
ccuguugggcaaugcucc

SEQ ID NO: 10251 - RNA, 18 nt, artificial
  Chemically synthesized
ugugugcauuugugcaca

SEQ ID NO: 10252 - RNA, 18 nt, artificial
  Chemically synthesized
aguauggaaaaguacacu

SEQ ID NO: 10253 - RNA, 18 nt, artificial
  Chemically synthesized
aggaaauagggaguuguc

SEQ ID NO: 10254 - RNA, 18 nt, artificial
  Chemically synthesized
ugaguucaaacuucuugg

SEQ ID NO: 10255 - RNA, 18 nt, artificial
  Chemically synthesized
ucagggcuguguguauuu

SEQ ID NO: 10256 - RNA, 18 nt, artificial
  Chemically synthesized
aggaacacuuaccuggag

SEQ ID NO: 10257 - RNA, 18 nt, artificial
  Chemically synthesized
cauaaaguaugguagagg

SEQ ID NO: 10258 - RNA, 18 nt, artificial
  Chemically synthesized
agagacauuguucuuuuc

SEQ ID NO: 10259 - RNA, 18 nt, artificial
  Chemically synthesized
aacccaugacaaagaaag

SEQ ID NO: 10260 - RNA, 18 nt, artificial
  Chemically synthesized
uugagaaaacaauguguc

SEQ ID NO: 10261 - RNA, 18 nt, artificial
  Chemically synthesized
ucuuucaaauuaccugag

SEQ ID NO: 10262 - RNA, 18 nt, artificial
  Chemically synthesized
gaugccuuuguuaucuac

SEQ ID NO: 10263 - RNA, 18 nt, artificial
  Chemically synthesized
ucuugguggaaguugaac

SEQ ID NO: 10264 - RNA, 18 nt, artificial
  Chemically synthesized
uagaggugaaaacaucua

SEQ ID NO: 10265 - RNA, 18 nt, artificial
  Chemically synthesized
aguaauuccauggugcac

SEQ ID NO: 10266 - RNA, 18 nt, artificial
  Chemically synthesized
aaggaacaguggguacag

SEQ ID NO: 10267 - RNA, 18 nt, artificial
  Chemically synthesized
ccugucccugaacccuau

SEQ ID NO: 10268 - RNA, 18 nt, artificial
  Chemically synthesized
auugcuguuuccuguugg

SEQ ID NO: 10269 - RNA, 18 nt, artificial
  Chemically synthesized
uacucagaaugacuuugc

SEQ ID NO: 10270 - RNA, 18 nt, artificial
  Chemically synthesized
gauuccagaaacauaugg

SEQ ID NO: 10271 - RNA, 18 nt, artificial
  Chemically synthesized
gcacuagauaugcagggc

SEQ ID NO: 10272 - RNA, 18 nt, artificial
  Chemically synthesized
cucaaggagcuuccagug

SEQ ID NO: 10273 - RNA, 18 nt, artificial
  Chemically synthesized
gaagugggaugaccucag

SEQ ID NO: 10274 - RNA, 18 nt, artificial
  Chemically synthesized
gcccugcuggaugguaaa

SEQ ID NO: 10275 - RNA, 18 nt, artificial
  Chemically synthesized
ucacaccagaguugcuuu

SEQ ID NO: 10276 - RNA, 18 nt, artificial
  Chemically synthesized
ucuagggugauugaacau

SEQ ID NO: 10277 - RNA, 18 nt, artificial
  Chemically synthesized
ucaguagaaauggcuuga

SEQ ID NO: 10278 - RNA, 18 nt, artificial
  Chemically synthesized
cucagcaggaacacuuac

SEQ ID NO: 10279 - RNA, 18 nt, artificial
  Chemically synthesized
uccagaaacauaugggcu

SEQ ID NO: 10280 - RNA, 18 nt, artificial
  Chemically synthesized
cuuguauucaaggucugg

SEQ ID NO: 10281 - RNA, 18 nt, artificial
  Chemically synthesized
cuacucaagccaggauga

SEQ ID NO: 10282 - RNA, 18 nt, artificial
  Chemically synthesized
ugaauacaccaauugcug

SEQ ID NO: 10283 - RNA, 18 nt, artificial
  Chemically synthesized
ugaaaacaucuaugaugc

SEQ ID NO: 10284 - RNA, 18 nt, artificial
  Chemically synthesized
agcccugggagccuuuuc

SEQ ID NO: 10285 - RNA, 18 nt, artificial
  Chemically synthesized
gccuggcugggacucuga

SEQ ID NO: 10286 - RNA, 18 nt, artificial
  Chemically synthesized
auuguucuuuuccugagu

SEQ ID NO: 10287 - RNA, 18 nt, artificial
  Chemically synthesized
cacuuccaacaaaggugg

SEQ ID NO: 10288 - RNA, 18 nt, artificial
  Chemically synthesized
guucccagaaaagaaugu

SEQ ID NO: 10289 - RNA, 18 nt, artificial
  Chemically synthesized
agugugcuuguaguaucu

SEQ ID NO: 10290 - RNA, 18 nt, artificial
  Chemically synthesized
ugaccucaugaaaugagu

SEQ ID NO: 10291 - RNA, 18 nt, artificial
  Chemically synthesized
auaaaagccgaaagguga

SEQ ID NO: 10292 - RNA, 18 nt, artificial
  Chemically synthesized
aagugauuuugggacaac

SEQ ID NO: 10293 - RNA, 18 nt, artificial
  Chemically synthesized
acuagugaaaguagaugu

SEQ ID NO: 10294 - RNA, 18 nt, artificial
  Chemically synthesized
guucucaaagugauuuug

SEQ ID NO: 10295 - RNA, 18 nt, artificial
  Chemically synthesized
gaaugcuaagguugccgc

SEQ ID NO: 10296 - RNA, 18 nt, artificial
  Chemically synthesized
cuccuugaccacauuuug

SEQ ID NO: 10297 - RNA, 18 nt, artificial
  Chemically synthesized
cuggguccaacacuuguu

SEQ ID NO: 10298 - RNA, 18 nt, artificial
  Chemically synthesized
ugcgugagaccagaaagc

SEQ ID NO: 10299 - RNA, 18 nt, artificial
  Chemically synthesized
uaagguugccgcuuucac

SEQ ID NO: 10300 - RNA, 18 nt, artificial
  Chemically synthesized
ugguaguuuugacugaac

SEQ ID NO: 10301 - RNA, 18 nt, artificial
  Chemically synthesized
uacacucugucacuuugu

SEQ ID NO: 10302 - RNA, 18 nt, artificial
  Chemically synthesized
ucuuuucauuggauacgu

SEQ ID NO: 10303 - RNA, 18 nt, artificial
  Chemically synthesized
aggaaacuuggaaaaguu

SEQ ID NO: 10304 - RNA, 18 nt, artificial
  Chemically synthesized
aauuuggacaguuuccca

SEQ ID NO: 10305 - RNA, 18 nt, artificial
  Chemically synthesized
cccagcuggguccaacac

SEQ ID NO: 10306 - RNA, 18 nt, artificial
  Chemically synthesized
ccucgcgccuggcuggga

SEQ ID NO: 10307 - RNA, 18 nt, artificial
  Chemically synthesized
cuggucugcaggcguuuu

SEQ ID NO: 10308 - RNA, 18 nt, artificial
  Chemically synthesized
uguguauuugaaagugug

SEQ ID NO: 10309 - RNA, 18 nt, artificial
  Chemically synthesized
uggaaaaguacacucugu

SEQ ID NO: 10310 - RNA, 18 nt, artificial
  Chemically synthesized
aggaugaggacuggguaa

SEQ ID NO: 10311 - RNA, 18 nt, artificial
  Chemically synthesized
cagaaacauaugggcuga

SEQ ID NO: 10312 - RNA, 18 nt, artificial
  Chemically synthesized
agggccugugcaauuuga

SEQ ID NO: 10313 - RNA, 18 nt, artificial
  Chemically synthesized
gagcccugcguggaggug

SEQ ID NO: 10314 - RNA, 18 nt, artificial
  Chemically synthesized
aagguggagaagacccug

SEQ ID NO: 10315 - RNA, 18 nt, artificial
  Chemically synthesized
uuauaaagaagguuccca

SEQ ID NO: 10316 - RNA, 18 nt, artificial
  Chemically synthesized
uugguuugagcaggucua

SEQ ID NO: 10317 - RNA, 18 nt, artificial
  Chemically synthesized
uaucaaguuuacagaagc

SEQ ID NO: 10318 - RNA, 18 nt, artificial
  Chemically synthesized
ugucaggccuuaugcuaa

SEQ ID NO: 10319 - RNA, 18 nt, artificial
  Chemically synthesized
agacuguaaucaagaacc

SEQ ID NO: 10320 - RNA, 18 nt, artificial
  Chemically synthesized
uaccaauuagacaacucc

SEQ ID NO: 10321 - RNA, 18 nt, artificial
  Chemically synthesized
agacauggaaacacaccc

SEQ ID NO: 10322 - RNA, 18 nt, artificial
  Chemically synthesized
accuuugaaacucaagcc

SEQ ID NO: 10323 - RNA, 18 nt, artificial
  Chemically synthesized
ucucaaacagccauagac

SEQ ID NO: 10324 - RNA, 18 nt, artificial
  Chemically synthesized
uuucaaauacacacagcc

SEQ ID NO: 10325 - RNA, 18 nt, artificial
  Chemically synthesized
uuuccuuaggaauuagcc

SEQ ID NO: 10326 - RNA, 18 nt, artificial
  Chemically synthesized
auucguucaacuuccacc

SEQ ID NO: 10327 - RNA, 18 nt, artificial
  Chemically synthesized
uacuuugaaucuuguugc

SEQ ID NO: 10328 - RNA, 18 nt, artificial
  Chemically synthesized
aauuguccaugauaagac

SEQ ID NO: 10329 - RNA, 18 nt, artificial
  Chemically synthesized
auuugauguagaacccgc

SEQ ID NO: 10330 - RNA, 18 nt, artificial
  Chemically synthesized
acuggugucuucucuucc

SEQ ID NO: 10331 - RNA, 18 nt, artificial
  Chemically synthesized
aaccuuugaaacucaagc

SEQ ID NO: 10332 - RNA, 18 nt, artificial
  Chemically synthesized
gaugcuagauuugucucc

SEQ ID NO: 10333 - RNA, 18 nt, artificial
  Chemically synthesized
aacucaucucaaacagcc

SEQ ID NO: 10334 - RNA, 18 nt, artificial
  Chemically synthesized
aaacagcaauguauacuc

SEQ ID NO: 10335 - RNA, 18 nt, artificial
  Chemically synthesized
uugucuggauuucacacc

SEQ ID NO: 10336 - RNA, 18 nt, artificial
  Chemically synthesized
ucauuucucccuuccucc

SEQ ID NO: 10337 - RNA, 18 nt, artificial
  Chemically synthesized
aaacagccauagacaucc

SEQ ID NO: 10338 - RNA, 18 nt, artificial
  Chemically synthesized
aaacugccaggucugagc

SEQ ID NO: 10339 - RNA, 18 nt, artificial
  Chemically synthesized
uugguugaaaugcccacc

SEQ ID NO: 10340 - RNA, 18 nt, artificial
  Chemically synthesized
aauacugaaaacucacuc

SEQ ID NO: 10341 - RNA, 18 nt, artificial
  Chemically synthesized
aagaguagagaacucauc

SEQ ID NO: 10342 - RNA, 18 nt, artificial
  Chemically synthesized
aucauagauguuuucacc

SEQ ID NO: 10343 - RNA, 18 nt, artificial
  Chemically synthesized
gaucuagaaacucaaggc

SEQ ID NO: 10344 - RNA, 18 nt, artificial
  Chemically synthesized
ugaguugguugaaaugcc

SEQ ID NO: 10345 - RNA, 18 nt, artificial
  Chemically synthesized
uagauuugucuccacagc

SEQ ID NO: 10346 - RNA, 18 nt, artificial
  Chemically synthesized
ucuucagauagauguugc

SEQ ID NO: 10347 - RNA, 18 nt, artificial
  Chemically synthesized
ugagugauaggaauacug

SEQ ID NO: 10348 - RNA, 18 nt, artificial
  Chemically synthesized
uccauugcaggaaacucu

SEQ ID NO: 10349 - RNA, 18 nt, artificial
  Chemically synthesized
ucuagagcagauuuguca

SEQ ID NO: 10350 - RNA, 18 nt, artificial
  Chemically synthesized
agaucuagaaacucaagg

SEQ ID NO: 10351 - RNA, 18 nt, artificial
  Chemically synthesized
uuagaagaagaaaacgcc

SEQ ID NO: 10352 - RNA, 18 nt, artificial
  Chemically synthesized
uagagagguggcuuaggc

SEQ ID NO: 10353 - RNA, 18 nt, artificial
  Chemically synthesized
ucacccuuagcauaaggc

SEQ ID NO: 10354 - RNA, 18 nt, artificial
  Chemically synthesized
ucuucuccaccuucugca

SEQ ID NO: 10355 - RNA, 18 nt, artificial
  Chemically synthesized
aagucucuguagugaagg

SEQ ID NO: 10356 - RNA, 18 nt, artificial
  Chemically synthesized
uugaguagauaacaaagg

SEQ ID NO: 10357 - RNA, 18 nt, artificial
  Chemically synthesized
uauuuccucauuucuccc

SEQ ID NO: 10358 - RNA, 18 nt, artificial
  Chemically synthesized
auuugucuccacagccac

SEQ ID NO: 10359 - RNA, 18 nt, artificial
  Chemically synthesized
auuaugugauugagacug

SEQ ID NO: 10360 - RNA, 18 nt, artificial
  Chemically synthesized
uuugucuccacagccacc

SEQ ID NO: 10361 - RNA, 18 nt, artificial
  Chemically synthesized
aagcggaaauuuucuucc

SEQ ID NO: 10362 - RNA, 18 nt, artificial
  Chemically synthesized
acagcaauguauacuccc

SEQ ID NO: 10363 - RNA, 18 nt, artificial
  Chemically synthesized
uauaaucacacucucuuc

SEQ ID NO: 10364 - RNA, 18 nt, artificial
  Chemically synthesized
aauaaagucucuguagug

SEQ ID NO: 10365 - RNA, 18 nt, artificial
  Chemically synthesized
aaaaauagaacaugcucg

SEQ ID NO: 10366 - RNA, 18 nt, artificial
  Chemically synthesized
gaaguucucuagagaugc

SEQ ID NO: 10367 - RNA, 18 nt, artificial
  Chemically synthesized
auuggauaagauugugag

SEQ ID NO: 10368 - RNA, 18 nt, artificial
  Chemically synthesized
cuauuuccucauuucucc

SEQ ID NO: 10369 - RNA, 18 nt, artificial
  Chemically synthesized
uguagaacccgcaagucu

SEQ ID NO: 10370 - RNA, 18 nt, artificial
  Chemically synthesized
agaacucaucucaaacag

SEQ ID NO: 10371 - RNA, 18 nt, artificial
  Chemically synthesized
auagauguugcuuccugc

SEQ ID NO: 10372 - RNA, 18 nt, artificial
  Chemically synthesized
guuagaagaagaaaacgc

SEQ ID NO: 10373 - RNA, 18 nt, artificial
  Chemically synthesized
uuucuacugagaucuaga

SEQ ID NO: 10374 - RNA, 18 nt, artificial
  Chemically synthesized
caucuugcaucaggagcc

SEQ ID NO: 10375 - RNA, 18 nt, artificial
  Chemically synthesized
uuguugcuggaaaggucc

SEQ ID NO: 10376 - RNA, 18 nt, artificial
  Chemically synthesized
uuucuggucucacgcagg

SEQ ID NO: 10377 - RNA, 18 nt, artificial
  Chemically synthesized
uugaaagcaacucuggug

SEQ ID NO: 10378 - RNA, 18 nt, artificial
  Chemically synthesized
uuugauguagaacccgca

SEQ ID NO: 10379 - RNA, 18 nt, artificial
  Chemically synthesized
agagguccaucaaacauc

SEQ ID NO: 10380 - RNA, 18 nt, artificial
  Chemically synthesized
uaggaauacugaaaacuc

SEQ ID NO: 10381 - RNA, 18 nt, artificial
  Chemically synthesized
augauaagaccaggaagc

SEQ ID NO: 10382 - RNA, 18 nt, artificial
  Chemically synthesized
accauggaauuacucacc

SEQ ID NO: 10383 - RNA, 18 nt, artificial
  Chemically synthesized
agugcucuagauugguca

SEQ ID NO: 10384 - RNA, 18 nt, artificial
  Chemically synthesized
ugcccaccuggaagacuc

SEQ ID NO: 10385 - RNA, 18 nt, artificial
  Chemically synthesized
auuguccaugauaagacc

SEQ ID NO: 10386 - RNA, 18 nt, artificial
  Chemically synthesized
aaaccuucauggaugaug

SEQ ID NO: 10387 - RNA, 18 nt, artificial
  Chemically synthesized
gagaugcuagauuugucu

SEQ ID NO: 10388 - RNA, 18 nt, artificial
  Chemically synthesized
aggagaggaaguuagaag

SEQ ID NO: 10389 - RNA, 18 nt, artificial
  Chemically synthesized
aaguaagccuuuugagag

SEQ ID NO: 10390 - RNA, 18 nt, artificial
  Chemically synthesized
uaaucaagaaccuggagg

SEQ ID NO: 10391 - RNA, 18 nt, artificial
  Chemically synthesized
uagauguugcuuccugcc

SEQ ID NO: 10392 - RNA, 18 nt, artificial
  Chemically synthesized
cuaauucuaaauguugcc

SEQ ID NO: 10393 - RNA, 18 nt, artificial
  Chemically synthesized
acuuugagaacagcaacc

SEQ ID NO: 10394 - RNA, 18 nt, artificial
  Chemically synthesized
augcuagauuugucucca

SEQ ID NO: 10395 - RNA, 18 nt, artificial
  Chemically synthesized
auucucccagaaccaaac

SEQ ID NO: 10396 - RNA, 18 nt, artificial
  Chemically synthesized
uuuucaagacuucgagac

SEQ ID NO: 10397 - RNA, 18 nt, artificial
  Chemically synthesized
auuacucacccuuagcau

SEQ ID NO: 10398 - RNA, 18 nt, artificial
  Chemically synthesized
uguauucaaagcaguucu

SEQ ID NO: 10399 - RNA, 18 nt, artificial
  Chemically synthesized
cuuauagaccagaacugc

SEQ ID NO: 10400 - RNA, 18 nt, artificial
  Chemically synthesized
ucaauaauaucaucgagg

SEQ ID NO: 10401 - RNA, 18 nt, artificial
  Chemically synthesized
auuucuaaauucucccag

SEQ ID NO: 10402 - RNA, 18 nt, artificial
  Chemically synthesized
uggauuccaugauuuacc

SEQ ID NO: 10403 - RNA, 18 nt, artificial
  Chemically synthesized
uuuccauucaaaagacuc

SEQ ID NO: 10404 - RNA, 18 nt, artificial
  Chemically synthesized
aauuacucacccuuagca

SEQ ID NO: 10405 - RNA, 18 nt, artificial
  Chemically synthesized
caauguauacucccugcc

SEQ ID NO: 10406 - RNA, 18 nt, artificial
  Chemically synthesized
uuucuguuuucucugucu

SEQ ID NO: 10407 - RNA, 18 nt, artificial
  Chemically synthesized
aaacucaaggcuugguag

SEQ ID NO: 10408 - RNA, 18 nt, artificial
  Chemically synthesized
cuugguagaucaacuucu

SEQ ID NO: 10409 - RNA, 18 nt, artificial
  Chemically synthesized
aguagagaacucaucuca

SEQ ID NO: 10410 - RNA, 18 nt, artificial
  Chemically synthesized
agacuacuguacaagcac

SEQ ID NO: 10411 - RNA, 18 nt, artificial
  Chemically synthesized
ggcauuugauguagaacc

SEQ ID NO: 10412 - RNA, 18 nt, artificial
  Chemically synthesized
uggacuucuaaaccagcc

SEQ ID NO: 10413 - RNA, 18 nt, artificial
  Chemically synthesized
guuccuugacugaguugg

SEQ ID NO: 10414 - RNA, 18 nt, artificial
  Chemically synthesized
uuuaguaccugaagacug

SEQ ID NO: 10415 - RNA, 18 nt, artificial
  Chemically synthesized
ucuucucuuccucgagcc

SEQ ID NO: 10416 - RNA, 18 nt, artificial
  Chemically synthesized
acuuauagaccagaacug

SEQ ID NO: 10417 - RNA, 18 nt, artificial
  Chemically synthesized
uuauaaggaaacguaucc

SEQ ID NO: 10418 - RNA, 18 nt, artificial
  Chemically synthesized
caacaaucaccuuucggc

SEQ ID NO: 10419 - RNA, 18 nt, artificial
  Chemically synthesized
aucuagaaacucaaggcu

SEQ ID NO: 10420 - RNA, 18 nt, artificial
  Chemically synthesized
uauucaaagcaguucugg

SEQ ID NO: 10421 - RNA, 18 nt, artificial
  Chemically synthesized
uaccuucacacguaguuc

SEQ ID NO: 10422 - RNA, 18 nt, artificial
  Chemically synthesized
ugauauuagcuuauaggc

SEQ ID NO: 10423 - RNA, 18 nt, artificial
  Chemically synthesized
agacuucgagacuggaca

SEQ ID NO: 10424 - RNA, 18 nt, artificial
  Chemically synthesized
agcuuucuggucucacgc

SEQ ID NO: 10425 - RNA, 18 nt, artificial
  Chemically synthesized
gaauuacucacccuuagc

SEQ ID NO: 10426 - RNA, 18 nt, artificial
  Chemically synthesized
aauauuaagguagagagg

SEQ ID NO: 10427 - RNA, 18 nt, artificial
  Chemically synthesized
aggcuugguagaucaacu

SEQ ID NO: 10428 - RNA, 18 nt, artificial
  Chemically synthesized
uuggaaugcuggaaaucc

SEQ ID NO: 10429 - RNA, 18 nt, artificial
  Chemically synthesized
agaugcuagauuugucuc

SEQ ID NO: 10430 - RNA, 18 nt, artificial
  Chemically synthesized
uucaaucacccuagaccu

SEQ ID NO: 10431 - RNA, 18 nt, artificial
  Chemically synthesized
ugaguuaaaugcuguugg

SEQ ID NO: 10432 - RNA, 18 nt, artificial
  Chemically synthesized
uugguagaucaacuucug

SEQ ID NO: 10433 - RNA, 18 nt, artificial
  Chemically synthesized
uuugaaucuuguugcugg

SEQ ID NO: 10434 - RNA, 18 nt, artificial
  Chemically synthesized
uucaaagcaguucugggc

SEQ ID NO: 10435 - RNA, 18 nt, artificial
  Chemically synthesized
auccauugcaggaaacuc

SEQ ID NO: 10436 - RNA, 18 nt, artificial
  Chemically synthesized
agaguagagaacucaucu

SEQ ID NO: 10437 - RNA, 18 nt, artificial
  Chemically synthesized
agaaguuugaacucaugg

SEQ ID NO: 10438 - RNA, 18 nt, artificial
  Chemically synthesized
uauguuucuggaaucaag

SEQ ID NO: 10439 - RNA, 18 nt, artificial
  Chemically synthesized
gucuccagaagaugugcc

SEQ ID NO: 10440 - RNA, 18 nt, artificial
  Chemically synthesized
cucaaaccaaacacacuc

SEQ ID NO: 10441 - RNA, 18 nt, artificial
  Chemically synthesized
uacugagaucuagaaacu

SEQ ID NO: 10442 - RNA, 18 nt, artificial
  Chemically synthesized
ucauuaugugauugagac

SEQ ID NO: 10443 - RNA, 18 nt, artificial
  Chemically synthesized
ucucuuuugucacaggag

SEQ ID NO: 10444 - RNA, 18 nt, artificial
  Chemically synthesized
aagcaaagucauucugag

SEQ ID NO: 10445 - RNA, 18 nt, artificial
  Chemically synthesized
ucucuuucuguuuucucu

SEQ ID NO: 10446 - RNA, 18 nt, artificial
  Chemically synthesized
gucugugcaauaaauacu

SEQ ID NO: 10447 - RNA, 18 nt, artificial
  Chemically synthesized
gaaggucaaguuucucag

SEQ ID NO: 10448 - RNA, 18 nt, artificial
  Chemically synthesized
aaacacucaguaacaaac

SEQ ID NO: 10449 - RNA, 18 nt, artificial
  Chemically synthesized
acaaguacaagcaaaguc

SEQ ID NO: 10450 - RNA, 18 nt, artificial
  Chemically synthesized
aaguuucucagcucugug

SEQ ID NO: 10451 - RNA, 18 nt, artificial
  Chemically synthesized
uuccuugaaaaauagugg

SEQ ID NO: 10452 - RNA, 18 nt, artificial
  Chemically synthesized
cucccagggcuaaacucu

SEQ ID NO: 10453 - RNA, 18 nt, artificial
  Chemically synthesized
ucuccacagccaccagcu

SEQ ID NO: 10454 - RNA, 18 nt, artificial
  Chemically synthesized
auuccaugauuuaccauc

SEQ ID NO: 10455 - RNA, 18 nt, artificial
  Chemically synthesized
agggauguucaaucaccc

SEQ ID NO: 10456 - RNA, 18 nt, artificial
  Chemically synthesized
acaccacaacaaucaccu

SEQ ID NO: 10457 - RNA, 18 nt, artificial
  Chemically synthesized
gauacuacaagcacacug

SEQ ID NO: 10458 - RNA, 18 nt, artificial
  Chemically synthesized
agagguccaggaagguca

SEQ ID NO: 10459 - RNA, 18 nt, artificial
  Chemically synthesized
auggaauuacucacccuu

SEQ ID NO: 10460 - RNA, 18 nt, artificial
  Chemically synthesized
ugauagggauacauaggg

SEQ ID NO: 10461 - RNA, 18 nt, artificial
  Chemically synthesized
uggcucauauuuaguacc

SEQ ID NO: 10462 - RNA, 18 nt, artificial
  Chemically synthesized
aagcauaagggauaaggg

SEQ ID NO: 10463 - RNA, 18 nt, artificial
  Chemically synthesized
agauguucuaguuguucu

SEQ ID NO: 10464 - RNA, 18 nt, artificial
  Chemically synthesized
acuccagguaaguguucc

SEQ ID NO: 10465 - RNA, 18 nt, artificial
  Chemically synthesized
uccuugagauuagcagcc

SEQ ID NO: 10466 - RNA, 18 nt, artificial
  Chemically synthesized
aaugaagaugauaccagc

SEQ ID NO: 10467 - RNA, 18 nt, artificial
  Chemically synthesized
gacugcucagaaacugcc

SEQ ID NO: 10468 - RNA, 18 nt, artificial
  Chemically synthesized
gaguagagaacucaucuc

SEQ ID NO: 10469 - RNA, 18 nt, artificial
  Chemically synthesized
aggucuaaagagagauug

SEQ ID NO: 10470 - RNA, 18 nt, artificial
  Chemically synthesized
uugcuuccugccaauugc

SEQ ID NO: 10471 - RNA, 18 nt, artificial
  Chemically synthesized
aagugcucuagauugguc

SEQ ID NO: 10472 - RNA, 18 nt, artificial
  Chemically synthesized
auuagacaacucccuauu

SEQ ID NO: 10473 - RNA, 18 nt, artificial
  Chemically synthesized
uucacacguaguucuccu

SEQ ID NO: 10474 - RNA, 18 nt, artificial
  Chemically synthesized
cuucuguaaacuugauag

SEQ ID NO: 10475 - RNA, 18 nt, artificial
  Chemically synthesized
uagucacacucaccaggg

SEQ ID NO: 10476 - RNA, 18 nt, artificial
  Chemically synthesized
accuuagcauucuggacu

SEQ ID NO: 10477 - RNA, 18 nt, artificial
  Chemically synthesized
caucauagauguuuucac

SEQ ID NO: 10478 - RNA, 18 nt, artificial
  Chemically synthesized
caccauggaauuacucac

SEQ ID NO: 10479 - RNA, 18 nt, artificial
  Chemically synthesized
uugcaggaaacucuggug

SEQ ID NO: 10480 - RNA, 18 nt, artificial
  Chemically synthesized
augauggucuuauucauc

SEQ ID NO: 10481 - RNA, 18 nt, artificial
  Chemically synthesized
uuggauaaaguucauagg

SEQ ID NO: 10482 - RNA, 18 nt, artificial
  Chemically synthesized
auaugugcacaaaugcac

SEQ ID NO: 10483 - RNA, 18 nt, artificial
  Chemically synthesized
gaggcuggaugaacauuc

SEQ ID NO: 10484 - RNA, 18 nt, artificial
  Chemically synthesized
gaacucaucucaaacagc

SEQ ID NO: 10485 - RNA, 18 nt, artificial
  Chemically synthesized
agaacaaugucucuuucu

SEQ ID NO: 10486 - RNA, 18 nt, artificial
  Chemically synthesized
aaagauacaccagcggcu

SEQ ID NO: 10487 - RNA, 18 nt, artificial
  Chemically synthesized
uuauagaccagaacugcu

SEQ ID NO: 10488 - RNA, 18 nt, artificial
  Chemically synthesized
acacuuucaaauacacac

SEQ ID NO: 10489 - RNA, 18 nt, artificial
  Chemically synthesized
aauugucuggauuucaca

SEQ ID NO: 10490 - RNA, 18 nt, artificial
  Chemically synthesized
uuaauuccagacacauug

SEQ ID NO: 10491 - RNA, 18 nt, artificial
  Chemically synthesized
ucaaaacuaccaaaaugg

SEQ ID NO: 10492 - RNA, 18 nt, artificial
  Chemically synthesized
accuucuuuauaagaacc

SEQ ID NO: 10493 - RNA, 18 nt, artificial
  Chemically synthesized
uucagagguccaucaaac

SEQ ID NO: 10494 - RNA, 18 nt, artificial
  Chemically synthesized
ugcuaaucggaauucuuc

SEQ ID NO: 10495 - RNA, 18 nt, artificial
  Chemically synthesized
aucggaauucuucaaugg

SEQ ID NO: 10496 - RNA, 18 nt, artificial
  Chemically synthesized
uuccuucuggauuccaug

SEQ ID NO: 10497 - RNA, 18 nt, artificial
  Chemically synthesized
agcacgucuuaaacaacc

SEQ ID NO: 10498 - RNA, 18 nt, artificial
  Chemically synthesized
agucugugcaauaaauac

SEQ ID NO: 10499 - RNA, 18 nt, artificial
  Chemically synthesized
aaugugggaaacugucca

SEQ ID NO: 10500 - RNA, 18 nt, artificial
  Chemically synthesized
uucugaaaaagcauuccc

SEQ ID NO: 10501 - RNA, 18 nt, artificial
  Chemically synthesized
aauguucuguuucugagg

SEQ ID NO: 10502 - RNA, 18 nt, artificial
  Chemically synthesized
uccuguacccacuguucc

SEQ ID NO: 10503 - RNA, 18 nt, artificial
  Chemically synthesized
ugauauucaaacucagca

SEQ ID NO: 10504 - RNA, 18 nt, artificial
  Chemically synthesized
ugauugagacuguaauca

SEQ ID NO: 10505 - RNA, 18 nt, artificial
  Chemically synthesized
uucuaaauguugccaucc

SEQ ID NO: 10506 - RNA, 18 nt, artificial
  Chemically synthesized
ccaauuagacaacucccu

SEQ ID NO: 10507 - RNA, 18 nt, artificial
  Chemically synthesized
gauauuugaagcacgucu

SEQ ID NO: 10508 - RNA, 18 nt, artificial
  Chemically synthesized
ucuuauucaucugacagg

SEQ ID NO: 10509 - RNA, 18 nt, artificial
  Chemically synthesized
aauacuuuaggcugguug

SEQ ID NO: 10510 - RNA, 18 nt, artificial
  Chemically synthesized
uaauaacaccauugaagc

SEQ ID NO: 10511 - RNA, 18 nt, artificial
  Chemically synthesized
uaacaaacacuucugacu

SEQ ID NO: 10512 - RNA, 18 nt, artificial
  Chemically synthesized
ucuagaaacucaaggcuu

SEQ ID NO: 10513 - RNA, 18 nt, artificial
  Chemically synthesized
uaugcuaaucggaauucu

SEQ ID NO: 10514 - RNA, 18 nt, artificial
  Chemically synthesized
auaugaucaugcggacac

SEQ ID NO: 10515 - RNA, 18 nt, artificial
  Chemically synthesized
cuagcucauuccuuaccc

SEQ ID NO: 10516 - RNA, 18 nt, artificial
  Chemically synthesized
auagucacacucaccagg

SEQ ID NO: 10517 - RNA, 18 nt, artificial
  Chemically synthesized
aagcucagaucuaaauac

SEQ ID NO: 10518 - RNA, 18 nt, artificial
  Chemically synthesized
aguguuggacccagcugg

SEQ ID NO: 10519 - RNA, 18 nt, artificial
  Chemically synthesized
uucgagacuggacaagcc

SEQ ID NO: 10520 - RNA, 18 nt, artificial
  Chemically synthesized
auugagacuguaaucaag

SEQ ID NO: 10521 - RNA, 18 nt, artificial
  Chemically synthesized
acacucucuucuauacag

SEQ ID NO: 10522 - RNA, 18 nt, artificial
  Chemically synthesized
auugcaggaaacucuggu

SEQ ID NO: 10523 - RNA, 18 nt, artificial
  Chemically synthesized
augucaagguaaaugagg

SEQ ID NO: 10524 - RNA, 18 nt, artificial
  Chemically synthesized
auaauaucaucgagguag

SEQ ID NO: 10525 - RNA, 18 nt, artificial
  Chemically synthesized
uucaaacucagcacaggc

SEQ ID NO: 10526 - RNA, 18 nt, artificial
  Chemically synthesized
gucuaaguaugcuaaucg

SEQ ID NO: 10527 - RNA, 18 nt, artificial
  Chemically synthesized
uuccugccaauugcaucc

SEQ ID NO: 10528 - RNA, 18 nt, artificial
  Chemically synthesized
cuagauuugucuccacag

SEQ ID NO: 10529 - RNA, 18 nt, artificial
  Chemically synthesized
uguucuaguuguucuaag

SEQ ID NO: 10530 - RNA, 18 nt, artificial
  Chemically synthesized
agaacugcuacaacagau

SEQ ID NO: 10531 - RNA, 18 nt, artificial
  Chemically synthesized
guucucuagagaugcuag

SEQ ID NO: 10532 - RNA, 18 nt, artificial
  Chemically synthesized
auaucuagugcaccaugg

SEQ ID NO: 10533 - RNA, 18 nt, artificial
  Chemically synthesized
aacuguccaaauuuacag

SEQ ID NO: 10534 - RNA, 18 nt, artificial
  Chemically synthesized
auugucuggauuucacac

SEQ ID NO: 10535 - RNA, 18 nt, artificial
  Chemically synthesized
ugcacuggaagcuccuug

SEQ ID NO: 10536 - RNA, 18 nt, artificial
  Chemically synthesized
uuuguuggaagugaaagu

SEQ ID NO: 10537 - RNA, 18 nt, artificial
  Chemically synthesized
gauuugucaaacuuuucc

SEQ ID NO: 10538 - RNA, 18 nt, artificial
  Chemically synthesized
aauggucaaauugcacag

SEQ ID NO: 10539 - RNA, 18 nt, artificial
  Chemically synthesized
uggaaagaauugccagcc

SEQ ID NO: 10540 - RNA, 18 nt, artificial
  Chemically synthesized
aacagcaauguauacucc

SEQ ID NO: 10541 - RNA, 18 nt, artificial
  Chemically synthesized
cucugugaagauaucugg

SEQ ID NO: 10542 - RNA, 18 nt, artificial
  Chemically synthesized
aaaauaaacuucugcugc

SEQ ID NO: 10543 - RNA, 18 nt, artificial
  Chemically synthesized
aucccacuuccuuccugc

SEQ ID NO: 10544 - RNA, 18 nt, artificial
  Chemically synthesized
gaacuuauagaccagaac

SEQ ID NO: 10545 - RNA, 18 nt, artificial
  Chemically synthesized
cucugcacuggaagcucc

SEQ ID NO: 10546 - RNA, 18 nt, artificial
  Chemically synthesized
cagccaucugugucuccc

SEQ ID NO: 10547 - RNA, 18 nt, artificial
  Chemically synthesized
auauuaagguagagaggu

SEQ ID NO: 10548 - RNA, 18 nt, artificial
  Chemically synthesized
auuugaguuucaaugugg

SEQ ID NO: 10549 - RNA, 18 nt, artificial
  Chemically synthesized
agaaggcgguacagcucc

SEQ ID NO: 10550 - RNA, 18 nt, artificial
  Chemically synthesized
uucuaaaccagccagacc

SEQ ID NO: 10551 - RNA, 18 nt, artificial
  Chemically synthesized
uuucaaugugggaaacug

SEQ ID NO: 10552 - RNA, 18 nt, artificial
  Chemically synthesized
gcauuugauguagaaccc

SEQ ID NO: 10553 - RNA, 18 nt, artificial
  Chemically synthesized
uagaaacucaaggcuugg

SEQ ID NO: 10554 - RNA, 18 nt, artificial
  Chemically synthesized
gacucuguauuuuagucu

SEQ ID NO: 10555 - RNA, 18 nt, artificial
  Chemically synthesized
cuccuugagauuagcagc

SEQ ID NO: 10556 - RNA, 18 nt, artificial
  Chemically synthesized
ugagcagggucuucucca

SEQ ID NO: 10557 - RNA, 18 nt, artificial
  Chemically synthesized
auacuacaagcacacuga

SEQ ID NO: 10558 - RNA, 18 nt, artificial
  Chemically synthesized
ucucuguagugaaggcag

SEQ ID NO: 10559 - RNA, 18 nt, artificial
  Chemically synthesized
guuggauaaaguucauag

SEQ ID NO: 10560 - RNA, 18 nt, artificial
  Chemically synthesized
auaacauccacucuuccc

SEQ ID NO: 10561 - RNA, 18 nt, artificial
  Chemically synthesized
agggcuaaacucuggaug

SEQ ID NO: 10562 - RNA, 18 nt, artificial
  Chemically synthesized
gucuucuccaccuucugc

SEQ ID NO: 10563 - RNA, 18 nt, artificial
  Chemically synthesized
agcagggucuucuccacc

SEQ ID NO: 10564 - RNA, 18 nt, artificial
  Chemically synthesized
auguuggcagcaauggcc

SEQ ID NO: 10565 - RNA, 18 nt, artificial
  Chemically synthesized
aauuagacaacucccuau

SEQ ID NO: 10566 - RNA, 18 nt, artificial
  Chemically synthesized
auaagaccaggaagcgga

SEQ ID NO: 10567 - RNA, 18 nt, artificial
  Chemically synthesized
ucauggguuccuugacug

SEQ ID NO: 10568 - RNA, 18 nt, artificial
  Chemically synthesized
auacauagggauaugugc

SEQ ID NO: 10569 - RNA, 18 nt, artificial
  Chemically synthesized
aauagucacacucaccag

SEQ ID NO: 10570 - RNA, 18 nt, artificial
  Chemically synthesized
uuccuuccugccucuagc

SEQ ID NO: 10571 - RNA, 18 nt, artificial
  Chemically synthesized
aaacuuuuccaaguuucc

SEQ ID NO: 10572 - RNA, 18 nt, artificial
  Chemically synthesized
auggauguauucuucaag

SEQ ID NO: 10573 - RNA, 18 nt, artificial
  Chemically synthesized
acucaagccauuucuacu

SEQ ID NO: 10574 - RNA, 18 nt, artificial
  Chemically synthesized
uggucuuauucaucugac

SEQ ID NO: 10575 - RNA, 18 nt, artificial
  Chemically synthesized
aucaaacaucacuuguuc

SEQ ID NO: 10576 - RNA, 18 nt, artificial
  Chemically synthesized
auugguguauucaaagca

SEQ ID NO: 10577 - RNA, 18 nt, artificial
  Chemically synthesized
ucugaaacacucaguaac

SEQ ID NO: 10578 - RNA, 18 nt, artificial
  Chemically synthesized
auucuggacuuuuguuuc

SEQ ID NO: 10579 - RNA, 18 nt, artificial
  Chemically synthesized
ugaacacccaguucaguc

SEQ ID NO: 10580 - RNA, 18 nt, artificial
  Chemically synthesized
aucgagugacaaagugac

SEQ ID NO: 10581 - RNA, 18 nt, artificial
  Chemically synthesized
ucuccagaagaugugccg

SEQ ID NO: 10582 - RNA, 18 nt, artificial
  Chemically synthesized
guacaagcaaagucauuc

SEQ ID NO: 10583 - RNA, 18 nt, artificial
  Chemically synthesized
cagcaaccuuugaaacuc

SEQ ID NO: 10584 - RNA, 18 nt, artificial
  Chemically synthesized
ucaggugaaaauagaacu

SEQ ID NO: 10585 - RNA, 18 nt, artificial
  Chemically synthesized
aaggcuugguagaucaac

SEQ ID NO: 10586 - RNA, 18 nt, artificial
  Chemically synthesized
uuuugagauguccaaugg

SEQ ID NO: 10587 - RNA, 18 nt, artificial
  Chemically synthesized
auuucuacugagaucuag

SEQ ID NO: 10588 - RNA, 18 nt, artificial
  Chemically synthesized
aggaaaaagugaacaccc

SEQ ID NO: 10589 - RNA, 18 nt, artificial
  Chemically synthesized
acacaccaaugauggucu

SEQ ID NO: 10590 - RNA, 18 nt, artificial
  Chemically synthesized
agaguugaaaugacuuuc

SEQ ID NO: 10591 - RNA, 18 nt, artificial
  Chemically synthesized
ugagccacauuaaguucu

SEQ ID NO: 10592 - RNA, 18 nt, artificial
  Chemically synthesized
auguagaacccgcaaguc

SEQ ID NO: 10593 - RNA, 18 nt, artificial
  Chemically synthesized
gaaugaccaggaugguug

SEQ ID NO: 10594 - RNA, 18 nt, artificial
  Chemically synthesized
uggaaauccagauguucu

SEQ ID NO: 10595 - RNA, 18 nt, artificial
  Chemically synthesized
acccagggauguucaauc

SEQ ID NO: 10596 - RNA, 18 nt, artificial
  Chemically synthesized
cagccagcaagaagcauc

SEQ ID NO: 10597 - RNA, 18 nt, artificial
  Chemically synthesized
uauuaagguagagaggug

SEQ ID NO: 10598 - RNA, 18 nt, artificial
  Chemically synthesized
caaugaagaugauaccag

SEQ ID NO: 10599 - RNA, 18 nt, artificial
  Chemically synthesized
cucccugccuugaauacc

SEQ ID NO: 10600 - RNA, 18 nt, artificial
  Chemically synthesized
uucuaguuguucuaagcc

SEQ ID NO: 10601 - RNA, 18 nt, artificial
  Chemically synthesized
uacaagcaaagucauucu

SEQ ID NO: 10602 - RNA, 18 nt, artificial
  Chemically synthesized
agaggaagugaaagcggc

SEQ ID NO: 10603 - RNA, 18 nt, artificial
  Chemically synthesized
acacuucugacugugguc

SEQ ID NO: 10604 - RNA, 18 nt, artificial
  Chemically synthesized
ccauggaauuacucaccc

SEQ ID NO: 10605 - RNA, 18 nt, artificial
  Chemically synthesized
acuguuccuucuggauuc

SEQ ID NO: 10606 - RNA, 18 nt, artificial
  Chemically synthesized
ugcuagauuugucuccac

SEQ ID NO: 10607 - RNA, 18 nt, artificial
  Chemically synthesized
uacaugagacauggaaac

SEQ ID NO: 10608 - RNA, 18 nt, artificial
  Chemically synthesized
auucuaaauguugccauc

SEQ ID NO: 10609 - RNA, 18 nt, artificial
  Chemically synthesized
acucuucccaaaaugugg

SEQ ID NO: 10610 - RNA, 18 nt, artificial
  Chemically synthesized
caaccuuugaaacucaag

SEQ ID NO: 10611 - RNA, 18 nt, artificial
  Chemically synthesized
uaaauucucccagaacca

SEQ ID NO: 10612 - RNA, 18 nt, artificial
  Chemically synthesized
uaaagucucuguagugaa

SEQ ID NO: 10613 - RNA, 18 nt, artificial
  Chemically synthesized
agaccuugaauacaaguu

SEQ ID NO: 10614 - RNA, 18 nt, artificial
  Chemically synthesized
gagauuugaguuucaaug

SEQ ID NO: 10615 - RNA, 18 nt, artificial
  Chemically synthesized
acaccuccacgcagggcu

SEQ ID NO: 10616 - RNA, 18 nt, artificial
  Chemically synthesized
guucugggcuaaagggug

SEQ ID NO: 10617 - RNA, 18 nt, artificial
  Chemically synthesized
gacaaugaagaugauacc

SEQ ID NO: 10618 - RNA, 18 nt, artificial
  Chemically synthesized
aaacacuucugacugugg

SEQ ID NO: 10619 - RNA, 18 nt, artificial
  Chemically synthesized
aaagugacagaguguacu

SEQ ID NO: 10620 - RNA, 18 nt, artificial
  Chemically synthesized
aagucagcuuaugaagcc

SEQ ID NO: 10621 - RNA, 18 nt, artificial
  Chemically synthesized
guucagacacuuauaagg

SEQ ID NO: 10622 - RNA, 18 nt, artificial
  Chemically synthesized
uugugagccacauuaagu

SEQ ID NO: 10623 - RNA, 18 nt, artificial
  Chemically synthesized
caggugauauucaaacuc

SEQ ID NO: 10624 - RNA, 18 nt, artificial
  Chemically synthesized
uauucaaagauacaccag

SEQ ID NO: 10625 - RNA, 18 nt, artificial
  Chemically synthesized
ggacaaugaagaugauac

SEQ ID NO: 10626 - RNA, 18 nt, artificial
  Chemically synthesized
augucucuuucuguuuuc

SEQ ID NO: 10627 - RNA, 18 nt, artificial
  Chemically synthesized
ucuggauuucacaccucc

SEQ ID NO: 10628 - RNA, 18 nt, artificial
  Chemically synthesized
uaucaucgagguaguagu

SEQ ID NO: 10629 - RNA, 18 nt, artificial
  Chemically synthesized
uuucaaauuggaaugcug

SEQ ID NO: 10630 - RNA, 18 nt, artificial
  Chemically synthesized
aagacucaggaaaagaac

SEQ ID NO: 10631 - RNA, 18 nt, artificial
  Chemically synthesized
aaggaaaaagugaacacc

SEQ ID NO: 10632 - RNA, 18 nt, artificial
  Chemically synthesized
cucuagagcagauuuguc

SEQ ID NO: 10633 - RNA, 18 nt, artificial
  Chemically synthesized
uacuguacaagcacaaga

SEQ ID NO: 10634 - RNA, 18 nt, artificial
  Chemically synthesized
cuuaggcucugauaugcc

SEQ ID NO: 10635 - RNA, 18 nt, artificial
  Chemically synthesized
cuuccuugaaaaauagug

SEQ ID NO: 10636 - RNA, 18 nt, artificial
  Chemically synthesized
cuuccaccaagagcugcc

SEQ ID NO: 10637 - RNA, 18 nt, artificial
  Chemically synthesized
uagaccagaacugcuaca

SEQ ID NO: 10638 - RNA, 18 nt, artificial
  Chemically synthesized
uauuuaguaccugaagac

SEQ ID NO: 10639 - RNA, 18 nt, artificial
  Chemically synthesized
uugagacuguaaucaaga

SEQ ID NO: 10640 - RNA, 18 nt, artificial
  Chemically synthesized
aauagaacaugcucgaga

SEQ ID NO: 10641 - RNA, 18 nt, artificial
  Chemically synthesized
cucaagccauuucuacug

SEQ ID NO: 10642 - RNA, 18 nt, artificial
  Chemically synthesized
cuucacacguaguucucc

SEQ ID NO: 10643 - RNA, 18 nt, artificial
  Chemically synthesized
ugacuuucuuugucaugg

SEQ ID NO: 10644 - RNA, 18 nt, artificial
  Chemically synthesized
cuguaaucaagaaccugg

SEQ ID NO: 10645 - RNA, 18 nt, artificial
  Chemically synthesized
cucuagcccaaauugucc

SEQ ID NO: 10646 - RNA, 18 nt, artificial
  Chemically synthesized
aucacuuugagaacagca

SEQ ID NO: 10647 - RNA, 18 nt, artificial
  Chemically synthesized
auugcauccuguacccac

SEQ ID NO: 10648 - RNA, 18 nt, artificial
  Chemically synthesized
ugauggucuuauucaucu

SEQ ID NO: 10649 - RNA, 18 nt, artificial
  Chemically synthesized
uuuucugagucgucucca

SEQ ID NO: 10650 - RNA, 18 nt, artificial
  Chemically synthesized
uuuucaccucuaccauac

SEQ ID NO: 10651 - RNA, 18 nt, artificial
  Chemically synthesized
uuucuuuaaaugcaccug

SEQ ID NO: 10652 - RNA, 18 nt, artificial
  Chemically synthesized
aagauacaccagcggcuc

SEQ ID NO: 10653 - RNA, 18 nt, artificial
  Chemically synthesized
auacugaaaacucacuca

SEQ ID NO: 10654 - RNA, 18 nt, artificial
  Chemically synthesized
agaaagcuagacuacuug

SEQ ID NO: 10655 - RNA, 18 nt, artificial
  Chemically synthesized
ugacuguggucauauuuc

SEQ ID NO: 10656 - RNA, 18 nt, artificial
  Chemically synthesized
ccuugaauaccuucacac

SEQ ID NO: 10657 - RNA, 18 nt, artificial
  Chemically synthesized
uuucuuugucauggguuc

SEQ ID NO: 10658 - RNA, 18 nt, artificial
  Chemically synthesized
agcccaagaaguuugaac

SEQ ID NO: 10659 - RNA, 18 nt, artificial
  Chemically synthesized
ugaacauucuuuucuggg

SEQ ID NO: 10660 - RNA, 18 nt, artificial
  Chemically synthesized
uggugucuucucuuccuc

SEQ ID NO: 10661 - RNA, 18 nt, artificial
  Chemically synthesized
cuucgagacuggacaagc

SEQ ID NO: 10662 - RNA, 18 nt, artificial
  Chemically synthesized
acucaugguaauaacacc

SEQ ID NO: 10663 - RNA, 18 nt, artificial
  Chemically synthesized
aauguauacucccugccu

SEQ ID NO: 10664 - RNA, 18 nt, artificial
  Chemically synthesized
aaaguaagccuuuugaga

SEQ ID NO: 10665 - RNA, 18 nt, artificial
  Chemically synthesized
cuuucaauagucacacuc

SEQ ID NO: 10666 - RNA, 18 nt, artificial
  Chemically synthesized
aaauccagauguucuagu

SEQ ID NO: 10667 - RNA, 18 nt, artificial
  Chemically synthesized
auuccuuacccaguccuc

SEQ ID NO: 10668 - RNA, 18 nt, artificial
  Chemically synthesized
uugaauaccuucacacgu

SEQ ID NO: 10669 - RNA, 18 nt, artificial
  Chemically synthesized
ucagaaacugccaggucu

SEQ ID NO: 10670 - RNA, 18 nt, artificial
  Chemically synthesized
uccaguugacacugagag

SEQ ID NO: 10671 - RNA, 18 nt, artificial
  Chemically synthesized
uaaucacacucucuucua

SEQ ID NO: 10672 - RNA, 18 nt, artificial
  Chemically synthesized
agucucuguagugaaggc

SEQ ID NO: 10673 - RNA, 18 nt, artificial
  Chemically synthesized
aacucaagccauuucuac

SEQ ID NO: 10674 - RNA, 18 nt, artificial
  Chemically synthesized
gaacccgcaagucugugc

SEQ ID NO: 10675 - RNA, 18 nt, artificial
  Chemically synthesized
uacacacagcccugauag

SEQ ID NO: 10676 - RNA, 18 nt, artificial
  Chemically synthesized
ugccauugaaagcaacuc

SEQ ID NO: 10677 - RNA, 18 nt, artificial
  Chemically synthesized
uauucaaacucagcacag

SEQ ID NO: 10678 - RNA, 18 nt, artificial
  Chemically synthesized
ugaacaaguguuggaccc

SEQ ID NO: 10679 - RNA, 18 nt, artificial
  Chemically synthesized
uccagaagaugugccgcc

SEQ ID NO: 10680 - RNA, 18 nt, artificial
  Chemically synthesized
acaagaguagagaacuca

SEQ ID NO: 10681 - RNA, 18 nt, artificial
  Chemically synthesized
cuuuucugagucgucucc

SEQ ID NO: 10682 - RNA, 18 nt, artificial
  Chemically synthesized
auggaaacacacccaggg

SEQ ID NO: 10683 - RNA, 18 nt, artificial
  Chemically synthesized
guguucacaaguacaagc

SEQ ID NO: 10684 - RNA, 18 nt, artificial
  Chemically synthesized
aauugguguauucaaagc

SEQ ID NO: 10685 - RNA, 18 nt, artificial
  Chemically synthesized
aucacacucucuucuaua

SEQ ID NO: 10686 - RNA, 18 nt, artificial
  Chemically synthesized
aagugaacacccaguuca

SEQ ID NO: 10687 - RNA, 18 nt, artificial
  Chemically synthesized
caaguacaagcaaaguca

SEQ ID NO: 10688 - RNA, 18 nt, artificial
  Chemically synthesized
agcaauguauacucccug

SEQ ID NO: 10689 - RNA, 18 nt, artificial
  Chemically synthesized
uuugucauggguuccuug

SEQ ID NO: 10690 - RNA, 18 nt, artificial
  Chemically synthesized
uccuuuucuugaauguuc

SEQ ID NO: 10691 - RNA, 18 nt, artificial
  Chemically synthesized
aagacuucgagacuggac

SEQ ID NO: 10692 - RNA, 18 nt, artificial
  Chemically synthesized
aguggcuaaagaaacagc

SEQ ID NO: 10693 - RNA, 18 nt, artificial
  Chemically synthesized
aaagcuagacuacuugga

SEQ ID NO: 10694 - RNA, 18 nt, artificial
  Chemically synthesized
ugaguaugagaaauguca

SEQ ID NO: 10695 - RNA, 18 nt, artificial
  Chemically synthesized
aucaggugaaaauagaac

SEQ ID NO: 10696 - RNA, 18 nt, artificial
  Chemically synthesized
cuuucuggucucacgcag

SEQ ID NO: 10697 - RNA, 18 nt, artificial
  Chemically synthesized
aaagcauucccaccuuug

SEQ ID NO: 10698 - RNA, 18 nt, artificial
  Chemically synthesized
cuucauggaugauguugg

SEQ ID NO: 10699 - RNA, 18 nt, artificial
  Chemically synthesized
cugucaauauuaagguag

SEQ ID NO: 10700 - RNA, 18 nt, artificial
  Chemically synthesized
cucuucagauagauguug

SEQ ID NO: 10701 - RNA, 18 nt, artificial
  Chemically synthesized
ucccagggcuaaacucug

SEQ ID NO: 10702 - RNA, 18 nt, artificial
  Chemically synthesized
uggucaaauugcacaggc

SEQ ID NO: 10703 - RNA, 18 nt, artificial
  Chemically synthesized
gacaccacaacaaucacc

SEQ ID NO: 10704 - RNA, 18 nt, artificial
  Chemically synthesized
aaaguuuugagaugucca

SEQ ID NO: 10705 - RNA, 18 nt, artificial
  Chemically synthesized
gucuaaagagagauugag

SEQ ID NO: 10706 - RNA, 18 nt, artificial
  Chemically synthesized
ugacaucgagugacaaag

SEQ ID NO: 10707 - RNA, 18 nt, artificial
  Chemically synthesized
uugcuggaaagguccaag

SEQ ID NO: 10708 - RNA, 18 nt, artificial
  Chemically synthesized
ucacacucucuucuauac

SEQ ID NO: 10709 - RNA, 18 nt, artificial
  Chemically synthesized
uucuccaccuucugcagg

SEQ ID NO: 10710 - RNA, 18 nt, artificial
  Chemically synthesized
ccuucuuuauaagaaccc

SEQ ID NO: 10711 - RNA, 18 nt, artificial
  Chemically synthesized
cuuccugccaauugcauc

SEQ ID NO: 10712 - RNA, 18 nt, artificial
  Chemically synthesized
cugagcagggucuucucc

SEQ ID NO: 10713 - RNA, 18 nt, artificial
  Chemically synthesized
ucuguauuuuagucuagc

SEQ ID NO: 10714 - RNA, 18 nt, artificial
  Chemically synthesized
uuccaugauuuaccaucc

SEQ ID NO: 10715 - RNA, 18 nt, artificial
  Chemically synthesized
uugagauuagcagcccug

SEQ ID NO: 10716 - RNA, 18 nt, artificial
  Chemically synthesized
ccaauugcauccuguacc

SEQ ID NO: 10717 - RNA, 18 nt, artificial
  Chemically synthesized
caagcauaagggauaagg

SEQ ID NO: 10718 - RNA, 18 nt, artificial
  Chemically synthesized
uggaaaccuucauggaug

SEQ ID NO: 10719 - RNA, 18 nt, artificial
  Chemically synthesized
agacucuguauuuuaguc

SEQ ID NO: 10720 - RNA, 18 nt, artificial
  Chemically synthesized
cagcuuucuggucucacg

SEQ ID NO: 10721 - RNA, 18 nt, artificial
  Chemically synthesized
cacauuguuuucucaaug

SEQ ID NO: 10722 - RNA, 18 nt, artificial
  Chemically synthesized
guaugagaaaugucaagg

SEQ ID NO: 10723 - RNA, 18 nt, artificial
  Chemically synthesized
uguucaaucacccuagac

SEQ ID NO: 10724 - RNA, 18 nt, artificial
  Chemically synthesized
aucauccuggcaucaucc

SEQ ID NO: 10725 - RNA, 18 nt, artificial
  Chemically synthesized
augcugcuuucaugacag

SEQ ID NO: 10726 - RNA, 18 nt, artificial
  Chemically synthesized
uaaacuucugcugcaacu

SEQ ID NO: 10727 - RNA, 18 nt, artificial
  Chemically synthesized
uugguguauucaaagcag

SEQ ID NO: 10728 - RNA, 18 nt, artificial
  Chemically synthesized
gucuuauucaucugacag

SEQ ID NO: 10729 - RNA, 18 nt, artificial
  Chemically synthesized
acgucuuaaacaaccuua

SEQ ID NO: 10730 - RNA, 18 nt, artificial
  Chemically synthesized
aacuuauagaccagaacu

SEQ ID NO: 10731 - RNA, 18 nt, artificial
  Chemically synthesized
ugaggucaucccacuucc

SEQ ID NO: 10732 - RNA, 18 nt, artificial
  Chemically synthesized
ugggcuaaagggugagag

SEQ ID NO: 10733 - RNA, 18 nt, artificial
  Chemically synthesized
acacguaguucuccuggc

SEQ ID NO: 10734 - RNA, 18 nt, artificial
  Chemically synthesized
uguauacucccugccuug

SEQ ID NO: 10735 - RNA, 18 nt, artificial
  Chemically synthesized
cagucauuacuuaguagg

SEQ ID NO: 10736 - RNA, 18 nt, artificial
  Chemically synthesized
ugugauugagacuguaau

SEQ ID NO: 10737 - RNA, 18 nt, artificial
  Chemically synthesized
caccgggaauaaagucuc

SEQ ID NO: 10738 - RNA, 18 nt, artificial
  Chemically synthesized
uggagagugaguuaaaug

SEQ ID NO: 10739 - RNA, 18 nt, artificial
  Chemically synthesized
aagauaucuggaaggaag

SEQ ID NO: 10740 - RNA, 18 nt, artificial
  Chemically synthesized
aaaucacuuugagaacag

SEQ ID NO: 10741 - RNA, 18 nt, artificial
  Chemically synthesized
cacuggugucuucucuuc

SEQ ID NO: 10742 - RNA, 18 nt, artificial
  Chemically synthesized
cuuuaggcugguuguccc

SEQ ID NO: 10743 - RNA, 18 nt, artificial
  Chemically synthesized
acugaacaaguguuggac

SEQ ID NO: 10744 - RNA, 18 nt, artificial
  Chemically synthesized
ggaauaaagucucuguag

SEQ ID NO: 10745 - RNA, 18 nt, artificial
  Chemically synthesized
uggcugggaucagagucc

SEQ ID NO: 10746 - RNA, 18 nt, artificial
  Chemically synthesized
ugccuugaauaccuucac

SEQ ID NO: 10747 - RNA, 18 nt, artificial
  Chemically synthesized
ugucuucucuuccucgag

SEQ ID NO: 10748 - RNA, 18 nt, artificial
  Chemically synthesized
acugcuucugugagcagc

SEQ ID NO: 10749 - RNA, 18 nt, artificial
  Chemically synthesized
cagggauguucaaucacc

SEQ ID NO: 10750 - RNA, 18 nt, artificial
  Chemically synthesized
aagcaacucuggugugag

SEQ ID NO: 10751 - RNA, 18 nt, artificial
  Chemically synthesized
uacccacuguuccuucug

SEQ ID NO: 10752 - RNA, 18 nt, artificial
  Chemically synthesized
ugagaucuagaaacucaa

SEQ ID NO: 10753 - RNA, 18 nt, artificial
  Chemically synthesized
uauggauauuugaagcac

SEQ ID NO: 10754 - RNA, 18 nt, artificial
  Chemically synthesized
uucuguuucugaggaggc

SEQ ID NO: 10755 - RNA, 18 nt, artificial
  Chemically synthesized
ucgucuccagaagaugug

SEQ ID NO: 10756 - RNA, 18 nt, artificial
  Chemically synthesized
ccgacacaccaaugaugg

SEQ ID NO: 10757 - RNA, 18 nt, artificial
  Chemically synthesized
gaaacugccaggucugag

SEQ ID NO: 10758 - RNA, 18 nt, artificial
  Chemically synthesized
acccuuagcauaaggccu

SEQ ID NO: 10759 - RNA, 18 nt, artificial
  Chemically synthesized
ucaguaacaaacacuucu

SEQ ID NO: 10760 - RNA, 18 nt, artificial
  Chemically synthesized
cucacccuuagcauaagg

SEQ ID NO: 10761 - RNA, 18 nt, artificial
  Chemically synthesized
agagugaguuaaaugcug

SEQ ID NO: 10762 - RNA, 18 nt, artificial
  Chemically synthesized
aaaagaaguuguuguggc

SEQ ID NO: 10763 - RNA, 18 nt, artificial
  Chemically synthesized
gaacaaugucucuuucug

SEQ ID NO: 10764 - RNA, 18 nt, artificial
  Chemically synthesized
ggaaaagaacaaugucuc

SEQ ID NO: 10765 - RNA, 18 nt, artificial
  Chemically synthesized
uuaucucuuuugucacag

SEQ ID NO: 10766 - RNA, 18 nt, artificial
  Chemically synthesized
guuuccuuaggaauuagc

SEQ ID NO: 10767 - RNA, 18 nt, artificial
  Chemically synthesized
caaugauggucuuauuca

SEQ ID NO: 10768 - RNA, 18 nt, artificial
  Chemically synthesized
aguucauaggguucaggg

SEQ ID NO: 10769 - RNA, 18 nt, artificial
  Chemically synthesized
auauucaaacucagcaca

SEQ ID NO: 10770 - RNA, 18 nt, artificial
  Chemically synthesized
uguucacaaguacaagca

SEQ ID NO: 10771 - RNA, 18 nt, artificial
  Chemically synthesized
uugacacugagagagguc

SEQ ID NO: 10772 - RNA, 18 nt, artificial
  Chemically synthesized
gaaacuguccaaauuuac

SEQ ID NO: 10773 - RNA, 18 nt, artificial
  Chemically synthesized
acaaaggcaucauagaug

SEQ ID NO: 10774 - RNA, 18 nt, artificial
  Chemically synthesized
ggucuucuccaccuucug

SEQ ID NO: 10775 - RNA, 18 nt, artificial
  Chemically synthesized
uuguccuuuucuugaaug

SEQ ID NO: 10776 - RNA, 18 nt, artificial
  Chemically synthesized
uugccagccauuuucaag

SEQ ID NO: 10777 - RNA, 18 nt, artificial
  Chemically synthesized
ucugguguucacaaguac

SEQ ID NO: 10778 - RNA, 18 nt, artificial
  Chemically synthesized
aacucaugguaauaacac

SEQ ID NO: 10779 - RNA, 18 nt, artificial
  Chemically synthesized
gucaucccacuuccuucc

SEQ ID NO: 10780 - RNA, 18 nt, artificial
  Chemically synthesized
gauuuaagaaagcuagac

SEQ ID NO: 10781 - RNA, 18 nt, artificial
  Chemically synthesized
gauguucaaucacccuag

SEQ ID NO: 10782 - RNA, 18 nt, artificial
  Chemically synthesized
ugcucaaaccaaacacac

SEQ ID NO: 10783 - RNA, 18 nt, artificial
  Chemically synthesized
ucaugcggacacacacac

SEQ ID NO: 10784 - RNA, 18 nt, artificial
  Chemically synthesized
ccauugaaagcaacucug

SEQ ID NO: 10785 - RNA, 18 nt, artificial
  Chemically synthesized
uucaaagauacaccagcg

SEQ ID NO: 10786 - RNA, 18 nt, artificial
  Chemically synthesized
uguagugaaggcagagcu

SEQ ID NO: 10787 - RNA, 18 nt, artificial
  Chemically synthesized
ucuagugcaccauggaau

SEQ ID NO: 10788 - RNA, 18 nt, artificial
  Chemically synthesized
ucgcuaucaccgucugac

SEQ ID NO: 10789 - RNA, 18 nt, artificial
  Chemically synthesized
acugaggaccgacacacc

SEQ ID NO: 10790 - RNA, 18 nt, artificial
  Chemically synthesized
ccgggaauaaagucucug

SEQ ID NO: 10791 - RNA, 18 nt, artificial
  Chemically synthesized
uagauuggucagauuaga

SEQ ID NO: 10792 - RNA, 18 nt, artificial
  Chemically synthesized
aucugacaggugauauuc

SEQ ID NO: 10793 - RNA, 18 nt, artificial
  Chemically synthesized
aacaaucaccuuucggcu

SEQ ID NO: 10794 - RNA, 18 nt, artificial
  Chemically synthesized
auccucacugcuucugug

SEQ ID NO: 10795 - RNA, 18 nt, artificial
  Chemically synthesized
uucucuagagaugcuaga

SEQ ID NO: 10796 - RNA, 18 nt, artificial
  Chemically synthesized
agcugggcaagaaaugcc

SEQ ID NO: 10797 - RNA, 18 nt, artificial
  Chemically synthesized
uuggaagugaaaguaagc

SEQ ID NO: 10798 - RNA, 18 nt, artificial
  Chemically synthesized
ugcucagaaacugccagg

SEQ ID NO: 10799 - RNA, 18 nt, artificial
  Chemically synthesized
auggacuucuaaaccagc

SEQ ID NO: 10800 - RNA, 18 nt, artificial
  Chemically synthesized
uuuauucccucugcacug

SEQ ID NO: 10801 - RNA, 18 nt, artificial
  Chemically synthesized
agggucuucuccaccuuc

SEQ ID NO: 10802 - RNA, 18 nt, artificial
  Chemically synthesized
uuaggcucugauaugccc

SEQ ID NO: 10803 - RNA, 18 nt, artificial
  Chemically synthesized
uucucuuccucgagccgc

SEQ ID NO: 10804 - RNA, 18 nt, artificial
  Chemically synthesized
uacagauaugaucaugcg

SEQ ID NO: 10805 - RNA, 18 nt, artificial
  Chemically synthesized
auggguuccuugacugag

SEQ ID NO: 10806 - RNA, 18 nt, artificial
  Chemically synthesized
uguuggagacaacugcuc

SEQ ID NO: 10807 - RNA, 18 nt, artificial
  Chemically synthesized
ucauagauguuuucaccu

SEQ ID NO: 10808 - RNA, 18 nt, artificial
  Chemically synthesized
acaacucccuauuuccuc

SEQ ID NO: 10809 - RNA, 18 nt, artificial
  Chemically synthesized
aaguucauaggguucagg

SEQ ID NO: 10810 - RNA, 18 nt, artificial
  Chemically synthesized
ucuggaugaagugcuggg

SEQ ID NO: 10811 - RNA, 18 nt, artificial
  Chemically synthesized
cacucaguaacaaacacu

SEQ ID NO: 10812 - RNA, 18 nt, artificial
  Chemically synthesized
gugauauucaaacucagc

SEQ ID NO: 10813 - RNA, 18 nt, artificial
  Chemically synthesized
uacugaaaacucacucau

SEQ ID NO: 10814 - RNA, 18 nt, artificial
  Chemically synthesized
accagaacugcuacaaca

SEQ ID NO: 10815 - RNA, 18 nt, artificial
  Chemically synthesized
auggcugggaucagaguc

SEQ ID NO: 10816 - RNA, 18 nt, artificial
  Chemically synthesized
acacuguccucccacucc

SEQ ID NO: 10817 - RNA, 18 nt, artificial
  Chemically synthesized
aaucuuguugcuggaaag

SEQ ID NO: 10818 - RNA, 18 nt, artificial
  Chemically synthesized
cagacacauuguuuucuc

SEQ ID NO: 10819 - RNA, 18 nt, artificial
  Chemically synthesized
aguucucuagagaugcua

SEQ ID NO: 10820 - RNA, 18 nt, artificial
  Chemically synthesized
uugaauguucuguuucug

SEQ ID NO: 10821 - RNA, 18 nt, artificial
  Chemically synthesized
guuuugagauguccaaug

SEQ ID NO: 10822 - RNA, 18 nt, artificial
  Chemically synthesized
guggcuaaagaaacagca

SEQ ID NO: 10823 - RNA, 18 nt, artificial
  Chemically synthesized
uccaagugcucuagauug

SEQ ID NO: 10824 - RNA, 18 nt, artificial
  Chemically synthesized
uguuucugaggaggcugg

SEQ ID NO: 10825 - RNA, 18 nt, artificial
  Chemically synthesized
aucugugucucccuaaag

SEQ ID NO: 10826 - RNA, 18 nt, artificial
  Chemically synthesized
ucuuuugucacaggagag

SEQ ID NO: 10827 - RNA, 18 nt, artificial
  Chemically synthesized
gaauaaagucucuguagu

SEQ ID NO: 10828 - RNA, 18 nt, artificial
  Chemically synthesized
gauggacuucuaaaccag

SEQ ID NO: 10829 - RNA, 18 nt, artificial
  Chemically synthesized
uucguucaacuuccacca

SEQ ID NO: 10830 - RNA, 18 nt, artificial
  Chemically synthesized
ucuaaauacuuuaggcug

SEQ ID NO: 10831 - RNA, 18 nt, artificial
  Chemically synthesized
ucuagagaugcuagauuu

SEQ ID NO: 10832 - RNA, 18 nt, artificial
  Chemically synthesized
ucauuccuuacccagucc

SEQ ID NO: 10833 - RNA, 18 nt, artificial
  Chemically synthesized
aagacuggagagugaguu

SEQ ID NO: 10834 - RNA, 18 nt, artificial
  Chemically synthesized
cauugaaagcaacucugg

SEQ ID NO: 10835 - RNA, 18 nt, artificial
  Chemically synthesized
aggucaaguuucucagcu

SEQ ID NO: 10836 - RNA, 18 nt, artificial
  Chemically synthesized
uaacauccacucuuccca

SEQ ID NO: 10837 - RNA, 18 nt, artificial
  Chemically synthesized
gaaacagcaauguauacu

SEQ ID NO: 10838 - RNA, 18 nt, artificial
  Chemically synthesized
auguuuucaccucuacca

SEQ ID NO: 10839 - RNA, 18 nt, artificial
  Chemically synthesized
aaccuucauggaugaugu

SEQ ID NO: 10840 - RNA, 18 nt, artificial
  Chemically synthesized
augacagucauuacuuag

SEQ ID NO: 10841 - RNA, 18 nt, artificial
  Chemically synthesized
gcuccuugagauuagcag

SEQ ID NO: 10842 - RNA, 18 nt, artificial
  Chemically synthesized
accuuucggcuuuuaugg

SEQ ID NO: 10843 - RNA, 18 nt, artificial
  Chemically synthesized
agauucagagguccauca

SEQ ID NO: 10844 - RNA, 18 nt, artificial
  Chemically synthesized
uaaagagauucagagguc

SEQ ID NO: 10845 - RNA, 18 nt, artificial
  Chemically synthesized
aagaugccauugaaagca

SEQ ID NO: 10846 - RNA, 18 nt, artificial
  Chemically synthesized
gaaaugucaagguaaaug

SEQ ID NO: 10847 - RNA, 18 nt, artificial
  Chemically synthesized
ucaaggcuugguagauca

SEQ ID NO: 10848 - RNA, 18 nt, artificial
  Chemically synthesized
caaacacuucugacugug

SEQ ID NO: 10849 - RNA, 18 nt, artificial
  Chemically synthesized
ucuagauuggucagauua

SEQ ID NO: 10850 - RNA, 18 nt, artificial
  Chemically synthesized
uguaguuccuguuuuuug

SEQ ID NO: 10851 - RNA, 18 nt, artificial
  Chemically synthesized
uuugaguuucaauguggg

SEQ ID NO: 10852 - RNA, 18 nt, artificial
  Chemically synthesized
ccauuucuacugagaucu

SEQ ID NO: 10853 - RNA, 18 nt, artificial
  Chemically synthesized
ucuagcccaaauugucca

SEQ ID NO: 10854 - RNA, 18 nt, artificial
  Chemically synthesized
aaaauguggucaaggagc

SEQ ID NO: 10855 - RNA, 18 nt, artificial
  Chemically synthesized
agcccugcauaucuagug

SEQ ID NO: 10856 - RNA, 18 nt, artificial
  Chemically synthesized
uuucaugacagucauuac

SEQ ID NO: 10857 - RNA, 18 nt, artificial
  Chemically synthesized
accaguggcuaaagaaac

SEQ ID NO: 10858 - RNA, 18 nt, artificial
  Chemically synthesized
uguacccacuguuccuuc

SEQ ID NO: 10859 - RNA, 18 nt, artificial
  Chemically synthesized
auagaacuuauagaccag

SEQ ID NO: 10860 - RNA, 18 nt, artificial
  Chemically synthesized
acugcuacaacagauacu

SEQ ID NO: 10861 - RNA, 18 nt, artificial
  Chemically synthesized
guaguagucuaaguaugc

SEQ ID NO: 10862 - RNA, 18 nt, artificial
  Chemically synthesized
aguucagucaaaacuacc

SEQ ID NO: 10863 - RNA, 18 nt, artificial
  Chemically synthesized
cauggaauuacucacccu

SEQ ID NO: 10864 - RNA, 18 nt, artificial
  Chemically synthesized
auugugagccacauuaag

SEQ ID NO: 10865 - RNA, 18 nt, artificial
  Chemically synthesized
acaugcucgagaaugacc

SEQ ID NO: 10866 - RNA, 18 nt, artificial
  Chemically synthesized
cugauagggauacauagg

SEQ ID NO: 10867 - RNA, 18 nt, artificial
  Chemically synthesized
cuuugagaacagcaaccu

SEQ ID NO: 10868 - RNA, 18 nt, artificial
  Chemically synthesized
augauaccagcacgacug

SEQ ID NO: 10869 - RNA, 18 nt, artificial
  Chemically synthesized
acacacucugaaacacuc

SEQ ID NO: 10870 - RNA, 18 nt, artificial
  Chemically synthesized
caucuucaauugucugga

SEQ ID NO: 10871 - RNA, 18 nt, artificial
  Chemically synthesized
cucauuccuuacccaguc

SEQ ID NO: 10872 - RNA, 18 nt, artificial
  Chemically synthesized
uaccauacuuuaugcagc

SEQ ID NO: 10873 - RNA, 18 nt, artificial
  Chemically synthesized
acacuuauaaggaaacgu

SEQ ID NO: 10874 - RNA, 18 nt, artificial
  Chemically synthesized
uggucaaggagcauugcc

SEQ ID NO: 10875 - RNA, 18 nt, artificial
  Chemically synthesized
aaccuuagcauucuggac

SEQ ID NO: 10876 - RNA, 18 nt, artificial
  Chemically synthesized
aaagucauucugaguaag

SEQ ID NO: 10877 - RNA, 18 nt, artificial
  Chemically synthesized
gcaaccuuagcauucugg

SEQ ID NO: 10878 - RNA, 18 nt, artificial
  Chemically synthesized
aggaaaagaacaaugucu

SEQ ID NO: 10879 - RNA, 18 nt, artificial
  Chemically synthesized
uaggguucagggacaggu

SEQ ID NO: 10880 - RNA, 18 nt, artificial
  Chemically synthesized
ucaaacaucacuuguucu

SEQ ID NO: 10881 - RNA, 18 nt, artificial
  Chemically synthesized
ucccugccuugaauaccu

SEQ ID NO: 10882 - RNA, 18 nt, artificial
  Chemically synthesized
agacuggacaagccauug

SEQ ID NO: 10883 - RNA, 18 nt, artificial
  Chemically synthesized
uuuccucauuucucccuu

SEQ ID NO: 10884 - RNA, 18 nt, artificial
  Chemically synthesized
cauuugauguagaacccg

SEQ ID NO: 10885 - RNA, 18 nt, artificial
  Chemically synthesized
auaacaccauugaagcuc

SEQ ID NO: 10886 - RNA, 18 nt, artificial
  Chemically synthesized
auugaaagcaacucuggu

SEQ ID NO: 10887 - RNA, 18 nt, artificial
  Chemically synthesized
cugcauaucuagugcacc

SEQ ID NO: 10888 - RNA, 18 nt, artificial
  Chemically synthesized
augguuuuaugauggcua

SEQ ID NO: 10889 - RNA, 18 nt, artificial
  Chemically synthesized
ccuauuuccucauuucuc

SEQ ID NO: 10890 - RNA, 18 nt, artificial
  Chemically synthesized
uucuuuacuagcucauuc

SEQ ID NO: 10891 - RNA, 18 nt, artificial
  Chemically synthesized
acacucugaaacacucag

SEQ ID NO: 10892 - RNA, 18 nt, artificial
  Chemically synthesized
gauguuuucaccucuacc

SEQ ID NO: 10893 - RNA, 18 nt, artificial
  Chemically synthesized
gacacaccaaugaugguc

SEQ ID NO: 10894 - RNA, 18 nt, artificial
  Chemically synthesized
agaaaacgccugcagacc

SEQ ID NO: 10895 - RNA, 18 nt, artificial
  Chemically synthesized
cugagaucuagaaacuca

SEQ ID NO: 10896 - RNA, 18 nt, artificial
  Chemically synthesized
aaguucucuagagaugcu

SEQ ID NO: 10897 - RNA, 18 nt, artificial
  Chemically synthesized
cacugaggaccgacacac

SEQ ID NO: 10898 - RNA, 18 nt, artificial
  Chemically synthesized
aagcuccuugagauuagc

SEQ ID NO: 10899 - RNA, 18 nt, artificial
  Chemically synthesized
agaggaaguuagaagaag

SEQ ID NO: 10900 - RNA, 18 nt, artificial
  Chemically synthesized
caauugguguauucaaag

SEQ ID NO: 10901 - RNA, 18 nt, artificial
  Chemically synthesized
auccuguacccacuguuc

SEQ ID NO: 10902 - RNA, 18 nt, artificial
  Chemically synthesized
uaaaccagccagaccuug

SEQ ID NO: 10903 - RNA, 18 nt, artificial
  Chemically synthesized
aaugucaagguaaaugag

SEQ ID NO: 10904 - RNA, 18 nt, artificial
  Chemically synthesized
agcacaagaguagagaac

SEQ ID NO: 10905 - RNA, 18 nt, artificial
  Chemically synthesized
augguaauaacaccauug

SEQ ID NO: 10906 - RNA, 18 nt, artificial
  Chemically synthesized
augagacauggaaacaca

SEQ ID NO: 10907 - RNA, 18 nt, artificial
  Chemically synthesized
agaacagcaaccuuugaa

SEQ ID NO: 10908 - RNA, 18 nt, artificial
  Chemically synthesized
uuguccaugauaagacca

SEQ ID NO: 10909 - RNA, 18 nt, artificial
  Chemically synthesized
agucgucuccagaagaug

SEQ ID NO: 10910 - RNA, 18 nt, artificial
  Chemically synthesized
ccuagaccugcucaaacc

SEQ ID NO: 10911 - RNA, 18 nt, artificial
  Chemically synthesized
uuuccaguuuugacaacu

SEQ ID NO: 10912 - RNA, 18 nt, artificial
  Chemically synthesized
gcaguucugggcuaaagg

SEQ ID NO: 10913 - RNA, 18 nt, artificial
  Chemically synthesized
ggaauacugaaaacucac

SEQ ID NO: 10914 - RNA, 18 nt, artificial
  Chemically synthesized
auagggauacauagggau

SEQ ID NO: 10915 - RNA, 18 nt, artificial
  Chemically synthesized
guugaaaugcccaccugg

SEQ ID NO: 10916 - RNA, 18 nt, artificial
  Chemically synthesized
aaucacuuugagaacagc

SEQ ID NO: 10917 - RNA, 18 nt, artificial
  Chemically synthesized
ugcuguuggagacaacug

SEQ ID NO: 10918 - RNA, 18 nt, artificial
  Chemically synthesized
gaaagcuagacuacuugg

SEQ ID NO: 10919 - RNA, 18 nt, artificial
  Chemically synthesized
gaagcggaaauuuucuuc

SEQ ID NO: 10920 - RNA, 18 nt, artificial
  Chemically synthesized
aagaaaugccucaggagg

SEQ ID NO: 10921 - RNA, 18 nt, artificial
  Chemically synthesized
uccuugauccauugcagg

SEQ ID NO: 10922 - RNA, 18 nt, artificial
  Chemically synthesized
aaguuugaacucauggua

SEQ ID NO: 10923 - RNA, 18 nt, artificial
  Chemically synthesized
ucuaaguaugcuaaucgg

SEQ ID NO: 10924 - RNA, 18 nt, artificial
  Chemically synthesized
guugguugaaaugcccac

SEQ ID NO: 10925 - RNA, 18 nt, artificial
  Chemically synthesized
aacucacucauuuguuuc

SEQ ID NO: 10926 - RNA, 18 nt, artificial
  Chemically synthesized
aagagcugccucuggucc

SEQ ID NO: 10927 - RNA, 18 nt, artificial
  Chemically synthesized
uacauagggauaugugca

SEQ ID NO: 10928 - RNA, 18 nt, artificial
  Chemically synthesized
aguucagacacuuauaag

SEQ ID NO: 10929 - RNA, 18 nt, artificial
  Chemically synthesized
cuuucacuaguacaugag

SEQ ID NO: 10930 - RNA, 18 nt, artificial
  Chemically synthesized
aaagcggcaaccuuagca

SEQ ID NO: 10931 - RNA, 18 nt, artificial
  Chemically synthesized
uaguccagaaaaggcucc

SEQ ID NO: 10932 - RNA, 18 nt, artificial
  Chemically synthesized
gauagauguugcuuccug

SEQ ID NO: 10933 - RNA, 18 nt, artificial
  Chemically synthesized
agauugugagccacauua

SEQ ID NO: 10934 - RNA, 18 nt, artificial
  Chemically synthesized
ugagaaggcgguacagcu

SEQ ID NO: 10935 - RNA, 18 nt, artificial
  Chemically synthesized
cugaguugguugaaaugc

SEQ ID NO: 10936 - RNA, 18 nt, artificial
  Chemically synthesized
cuaguacaugagacaugg

SEQ ID NO: 10937 - RNA, 18 nt, artificial
  Chemically synthesized
cucacugcuucugugagc

SEQ ID NO: 10938 - RNA, 18 nt, artificial
  Chemically synthesized
uagacuacuuggaaaaug

SEQ ID NO: 10939 - RNA, 18 nt, artificial
  Chemically synthesized
gggucuucuccaccuucu

SEQ ID NO: 10940 - RNA, 18 nt, artificial
  Chemically synthesized
aaacaucacuuguucuga

SEQ ID NO: 10941 - RNA, 18 nt, artificial
  Chemically synthesized
aacacacucugaaacacu

SEQ ID NO: 10942 - RNA, 18 nt, artificial
  Chemically synthesized
acuucugcugcaacucau

SEQ ID NO: 10943 - RNA, 18 nt, artificial
  Chemically synthesized
uuggauaagauugugagc

SEQ ID NO: 10944 - RNA, 18 nt, artificial
  Chemically synthesized
caguucugggcuaaaggg

SEQ ID NO: 10945 - RNA, 18 nt, artificial
  Chemically synthesized
ggaauucuucaaugguca

SEQ ID NO: 10946 - RNA, 18 nt, artificial
  Chemically synthesized
ugacaaagugacagagug

SEQ ID NO: 10947 - RNA, 18 nt, artificial
  Chemically synthesized
acucaucucaaacagcca

SEQ ID NO: 10948 - RNA, 18 nt, artificial
  Chemically synthesized
aagcacgucuuaaacaac

SEQ ID NO: 10949 - RNA, 18 nt, artificial
  Chemically synthesized
uggucucacgcaggagag

SEQ ID NO: 10950 - RNA, 18 nt, artificial
  Chemically synthesized
acaccgggaauaaagucu

SEQ ID NO: 10951 - RNA, 18 nt, artificial
  Chemically synthesized
agauuggauaagauugug

SEQ ID NO: 10952 - RNA, 18 nt, artificial
  Chemically synthesized
uaucuggaaggaaguuuu

SEQ ID NO: 10953 - RNA, 18 nt, artificial
  Chemically synthesized
cugauuguccuuuucuug

SEQ ID NO: 10954 - RNA, 18 nt, artificial
  Chemically synthesized
gaaacucaaggcuuggua

SEQ ID NO: 10955 - RNA, 18 nt, artificial
  Chemically synthesized
acuugaugagguaagagu

SEQ ID NO: 10956 - RNA, 18 nt, artificial
  Chemically synthesized
aaacacacucugaaacac

SEQ ID NO: 10957 - RNA, 18 nt, artificial
  Chemically synthesized
augaacauucuuuucugg

SEQ ID NO: 10958 - RNA, 18 nt, artificial
  Chemically synthesized
aaucaagaaaaggugacc

SEQ ID NO: 10959 - RNA, 18 nt, artificial
  Chemically synthesized
caugauuuaccauccagc

SEQ ID NO: 10960 - RNA, 18 nt, artificial
  Chemically synthesized
acuguaaucaagaaccug

SEQ ID NO: 10961 - RNA, 18 nt, artificial
  Chemically synthesized
aacagcaaccuuugaaac

SEQ ID NO: 10962 - RNA, 18 nt, artificial
  Chemically synthesized
caguugacacugagagag

SEQ ID NO: 10963 - RNA, 18 nt, artificial
  Chemically synthesized
auaccuucacacguaguu

SEQ ID NO: 10964 - RNA, 18 nt, artificial
  Chemically synthesized
auagauguuuucaccucu

SEQ ID NO: 10965 - RNA, 18 nt, artificial
  Chemically synthesized
uagagaugcuagauuugu

SEQ ID NO: 10966 - RNA, 18 nt, artificial
  Chemically synthesized
auauuugaagcacgucuu

SEQ ID NO: 10967 - RNA, 18 nt, artificial
  Chemically synthesized
gucucuguagugaaggca

SEQ ID NO: 10968 - RNA, 18 nt, artificial
  Chemically synthesized
ucaaugauaacauccacu

SEQ ID NO: 10969 - RNA, 18 nt, artificial
  Chemically synthesized
cugguuggauaaaguuca

SEQ ID NO: 10970 - RNA, 18 nt, artificial
  Chemically synthesized
ugucucuuucuguuuucu

SEQ ID NO: 10971 - RNA, 18 nt, artificial
  Chemically synthesized
aaggucaaguuucucagc

SEQ ID NO: 10972 - RNA, 18 nt, artificial
  Chemically synthesized
ucacugcuucugugagca

SEQ ID NO: 10973 - RNA, 18 nt, artificial
  Chemically synthesized
uagagaacucaucucaaa

SEQ ID NO: 10974 - RNA, 18 nt, artificial
  Chemically synthesized
ggcucuggaugaagugcu

SEQ ID NO: 10975 - RNA, 18 nt, artificial
  Chemically synthesized
uugcauccuguacccacu

SEQ ID NO: 10976 - RNA, 18 nt, artificial
  Chemically synthesized
ccaucuucaauugucugg

SEQ ID NO: 10977 - RNA, 18 nt, artificial
  Chemically synthesized
agagucccagccaggcgc

SEQ ID NO: 10978 - RNA, 18 nt, artificial
  Chemically synthesized
uuucuaaauucucccaga

SEQ ID NO: 10979 - RNA, 18 nt, artificial
  Chemically synthesized
uagcucauuccuuaccca

SEQ ID NO: 10980 - RNA, 18 nt, artificial
  Chemically synthesized
cuuuuccaaguuuccuuc

SEQ ID NO: 10981 - RNA, 18 nt, artificial
  Chemically synthesized
aggcacuggugucuucuc

SEQ ID NO: 10982 - RNA, 18 nt, artificial
  Chemically synthesized
uugccauccgaaauuaua

SEQ ID NO: 10983 - RNA, 18 nt, artificial
  Chemically synthesized
aaugcuggaaauccagau

SEQ ID NO: 10984 - RNA, 18 nt, artificial
  Chemically synthesized
aguucugggcuaaagggu

SEQ ID NO: 10985 - RNA, 18 nt, artificial
  Chemically synthesized
aacaaugucucuuucugu

SEQ ID NO: 10986 - RNA, 18 nt, artificial
  Chemically synthesized
cuucuaaaccagccagac

SEQ ID NO: 10987 - RNA, 18 nt, artificial
  Chemically synthesized
aucacccuagaccugcuc

SEQ ID NO: 10988 - RNA, 18 nt, artificial
  Chemically synthesized
uucccucugcacuggaag

SEQ ID NO: 10989 - RNA, 18 nt, artificial
  Chemically synthesized
gggagacuacuguacaag

SEQ ID NO: 10990 - RNA, 18 nt, artificial
  Chemically synthesized
gaucuaaauacuuuaggc

SEQ ID NO: 10991 - RNA, 18 nt, artificial
  Chemically synthesized
cuuuguuggaagugaaag

SEQ ID NO: 10992 - RNA, 18 nt, artificial
  Chemically synthesized
uuuaaaugcaccugguug

SEQ ID NO: 10993 - RNA, 18 nt, artificial
  Chemically synthesized
acaaguguuggacccagc

SEQ ID NO: 10994 - RNA, 18 nt, artificial
  Chemically synthesized
cucaaggcuugguagauc

SEQ ID NO: 10995 - RNA, 18 nt, artificial
  Chemically synthesized
acaacaaucaccuuucgg

SEQ ID NO: 10996 - RNA, 18 nt, artificial
  Chemically synthesized
caugcucgagaaugacca

SEQ ID NO: 10997 - RNA, 18 nt, artificial
  Chemically synthesized
uaaggaaacguauccaau

SEQ ID NO: 10998 - RNA, 18 nt, artificial
  Chemically synthesized
cuuauaaggaaacguauc

SEQ ID NO: 10999 - RNA, 18 nt, artificial
  Chemically synthesized
auaaagucucuguaguga

SEQ ID NO: 11000 - RNA, 18 nt, artificial
  Chemically synthesized
cauuuucaagacuucgag

SEQ ID NO: 11001 - RNA, 18 nt, artificial
  Chemically synthesized
ugaggaggcuggaugaac

SEQ ID NO: 11002 - RNA, 18 nt, artificial
  Chemically synthesized
cgacugcucagaaacugc

SEQ ID NO: 11003 - RNA, 18 nt, artificial
  Chemically synthesized
uggaaagguccaagugcu

SEQ ID NO: 11004 - RNA, 18 nt, artificial
  Chemically synthesized
augcuggaaauccagaug

SEQ ID NO: 11005 - RNA, 18 nt, artificial
  Chemically synthesized
ugaagaugauaccagcac

SEQ ID NO: 11006 - RNA, 18 nt, artificial
  Chemically synthesized
guaauaacaccauugaag

SEQ ID NO: 11007 - RNA, 18 nt, artificial
  Chemically synthesized
agcggaaauuuucuuccc

SEQ ID NO: 11008 - RNA, 18 nt, artificial
  Chemically synthesized
aaucacccuagaccugcu

SEQ ID NO: 11009 - RNA, 18 nt, artificial
  Chemically synthesized
uuucucagcucugugaag

SEQ ID NO: 11010 - RNA, 18 nt, artificial
  Chemically synthesized
agacuuaaaauggaaggg

SEQ ID NO: 11011 - RNA, 18 nt, artificial
  Chemically synthesized
ucuggaaggaaguuuucc

SEQ ID NO: 11012 - RNA, 18 nt, artificial
  Chemically synthesized
uacuuucacuaguacaug

SEQ ID NO: 11013 - RNA, 18 nt, artificial
  Chemically synthesized
cuugaauaccuucacacg

SEQ ID NO: 11014 - RNA, 18 nt, artificial
  Chemically synthesized
ugagaggaagugaaagcg

SEQ ID NO: 11015 - RNA, 18 nt, artificial
  Chemically synthesized
ucaaaccaaacacacucu

SEQ ID NO: 11016 - RNA, 18 nt, artificial
  Chemically synthesized
aggugauauucaaacuca

SEQ ID NO: 11017 - RNA, 18 nt, artificial
  Chemically synthesized
cucauuucucccuuccuc

SEQ ID NO: 11018 - RNA, 18 nt, artificial
  Chemically synthesized
cucaggaaaagaacaaug

SEQ ID NO: 11019 - RNA, 18 nt, artificial
  Chemically synthesized
aaugguuuuaugauggcu

SEQ ID NO: 11020 - RNA, 18 nt, artificial
  Chemically synthesized
uggaaucaagaaaaggug

SEQ ID NO: 11021 - RNA, 18 nt, artificial
  Chemically synthesized
acaaaugcacacaucuac

SEQ ID NO: 11022 - RNA, 18 nt, artificial
  Chemically synthesized
gugaaaguaagccuuuug

SEQ ID NO: 11023 - RNA, 18 nt, artificial
  Chemically synthesized
uguggucaaggagcauug

SEQ ID NO: 11024 - RNA, 18 nt, artificial
  Chemically synthesized
uaguagucuaaguaugcu

SEQ ID NO: 11025 - RNA, 18 nt, artificial
  Chemically synthesized
cucagcacaggcaugccc

SEQ ID NO: 11026 - RNA, 18 nt, artificial
  Chemically synthesized
ucgagaaugaccaggaug

SEQ ID NO: 11027 - RNA, 18 nt, artificial
  Chemically synthesized
aagaacaaugucucuuuc

SEQ ID NO: 11028 - RNA, 18 nt, artificial
  Chemically synthesized
gcauucccaccuuuguug

SEQ ID NO: 11029 - RNA, 18 nt, artificial
  Chemically synthesized
gcaaucucauauucaaag

SEQ ID NO: 11030 - RNA, 18 nt, artificial
  Chemically synthesized
ugcaggacaaugaagaug

SEQ ID NO: 11031 - RNA, 18 nt, artificial
  Chemically synthesized
aaagugaacacccaguuc

SEQ ID NO: 11032 - RNA, 18 nt, artificial
  Chemically synthesized
uuccuuacccaguccuca

SEQ ID NO: 11033 - RNA, 18 nt, artificial
  Chemically synthesized
gaauuagccacuagacuu

SEQ ID NO: 11034 - RNA, 18 nt, artificial
  Chemically synthesized
aucuugcaucaggagccc

SEQ ID NO: 11035 - RNA, 18 nt, artificial
  Chemically synthesized
acgccugcagaccagugg

SEQ ID NO: 11036 - RNA, 18 nt, artificial
  Chemically synthesized
uguacuuuuccauacuuc

SEQ ID NO: 11037 - RNA, 18 nt, artificial
  Chemically synthesized
agacacuuauaaggaaac

SEQ ID NO: 11038 - RNA, 18 nt, artificial
  Chemically synthesized
gaugaacauucuuuucug

SEQ ID NO: 11039 - RNA, 18 nt, artificial
  Chemically synthesized
auguguuaaucagguuuc

SEQ ID NO: 11040 - RNA, 18 nt, artificial
  Chemically synthesized
augcacacaucuacuuuc

SEQ ID NO: 11041 - RNA, 18 nt, artificial
  Chemically synthesized
agacucaggaaaagaaca

SEQ ID NO: 11042 - RNA, 18 nt, artificial
  Chemically synthesized
aagaaguuugaacucaug

SEQ ID NO: 11043 - RNA, 18 nt, artificial
  Chemically synthesized
aagagagauugaguaggg

SEQ ID NO: 11044 - RNA, 18 nt, artificial
  Chemically synthesized
agaccaggaagcggaaau

SEQ ID NO: 11045 - RNA, 18 nt, artificial
  Chemically synthesized
uuucaauagucacacuca

SEQ ID NO: 11046 - RNA, 18 nt, artificial
  Chemically synthesized
aucccagccaucuguguc

SEQ ID NO: 11047 - RNA, 18 nt, artificial
  Chemically synthesized
agacacauuguuuucuca

SEQ ID NO: 11048 - RNA, 18 nt, artificial
  Chemically synthesized
ggcacuggugucuucucu

SEQ ID NO: 11049 - RNA, 18 nt, artificial
  Chemically synthesized
cuuacccaguccucaucc

SEQ ID NO: 11050 - RNA, 18 nt, artificial
  Chemically synthesized
uucugacuguggucauau

SEQ ID NO: 11051 - RNA, 18 nt, artificial
  Chemically synthesized
gguaguagucuaaguaug

SEQ ID NO: 11052 - RNA, 18 nt, artificial
  Chemically synthesized
uugauaguccagaaaagg

SEQ ID NO: 11053 - RNA, 18 nt, artificial
  Chemically synthesized
auaucaucgagguaguag

SEQ ID NO: 11054 - RNA, 18 nt, artificial
  Chemically synthesized
uuucugaggcacuggugu

SEQ ID NO: 11055 - RNA, 18 nt, artificial
  Chemically synthesized
acaggucuaaagagagau

SEQ ID NO: 11056 - RNA, 18 nt, artificial
  Chemically synthesized
aagaaguuguuguggcuc

SEQ ID NO: 11057 - RNA, 18 nt, artificial
  Chemically synthesized
cagauacuacaagcacac

SEQ ID NO: 11058 - RNA, 18 nt, artificial
  Chemically synthesized
ucuaaagagagauugagu

SEQ ID NO: 11059 - RNA, 18 nt, artificial
  Chemically synthesized
acucucuucuauacagau

SEQ ID NO: 11060 - RNA, 18 nt, artificial
  Chemically synthesized
uuuggaaugacaucgagu

SEQ ID NO: 11061 - RNA, 18 nt, artificial
  Chemically synthesized
gcacuggugucuucucuu

SEQ ID NO: 11062 - RNA, 18 nt, artificial
  Chemically synthesized
auggucaaauugcacagg

SEQ ID NO: 11063 - RNA, 18 nt, artificial
  Chemically synthesized
uguuaaucagguuuccuu

SEQ ID NO: 11064 - RNA, 18 nt, artificial
  Chemically synthesized
cuuaucugaagguguugc

SEQ ID NO: 11065 - RNA, 18 nt, artificial
  Chemically synthesized
accauugaagcucagauc

SEQ ID NO: 11066 - RNA, 18 nt, artificial
  Chemically synthesized
uaccugaagacuggagag

SEQ ID NO: 11067 - RNA, 18 nt, artificial
  Chemically synthesized
gguccaucaaacaucacu

SEQ ID NO: 11068 - RNA, 18 nt, artificial
  Chemically synthesized
uacaacagauacuacaag

SEQ ID NO: 11069 - RNA, 18 nt, artificial
  Chemically synthesized
guccuugauccauugcag

SEQ ID NO: 11070 - RNA, 18 nt, artificial
  Chemically synthesized
ccaaugauggucuuauuc

SEQ ID NO: 11071 - RNA, 18 nt, artificial
  Chemically synthesized
gccacauuaaguucuuuc

SEQ ID NO: 11072 - RNA, 18 nt, artificial
  Chemically synthesized
uuucugagugauaggaau

SEQ ID NO: 11073 - RNA, 18 nt, artificial
  Chemically synthesized
cgucuuaaacaaccuuau

SEQ ID NO: 11074 - RNA, 18 nt, artificial
  Chemically synthesized
cucccagcuuucuggucu

SEQ ID NO: 11075 - RNA, 18 nt, artificial
  Chemically synthesized
aaggcagagcugaaaugg

SEQ ID NO: 11076 - RNA, 18 nt, artificial
  Chemically synthesized
uccaucaaacaucacuug

SEQ ID NO: 11077 - RNA, 18 nt, artificial
  Chemically synthesized
uuuugucacaggagagga

SEQ ID NO: 11078 - RNA, 18 nt, artificial
  Chemically synthesized
ugaagacuggagagugag

SEQ ID NO: 11079 - RNA, 18 nt, artificial
  Chemically synthesized
ugaagguguugcacauuc

SEQ ID NO: 11080 - RNA, 18 nt, artificial
  Chemically synthesized
uggcuugaguagauaaca

SEQ ID NO: 11081 - RNA, 18 nt, artificial
  Chemically synthesized
cuacaagcacacugagga

SEQ ID NO: 11082 - RNA, 18 nt, artificial
  Chemically synthesized
agauaugaucaugcggac

SEQ ID NO: 11083 - RNA, 18 nt, artificial
  Chemically synthesized
uagcccaaauuguccaug

SEQ ID NO: 11084 - RNA, 18 nt, artificial
  Chemically synthesized
gauuugucuccacagcca

SEQ ID NO: 11085 - RNA, 18 nt, artificial
  Chemically synthesized
ugagcauguguuaaucag

SEQ ID NO: 11086 - RNA, 18 nt, artificial
  Chemically synthesized
ucuucaauugucuggauu

SEQ ID NO: 11087 - RNA, 18 nt, artificial
  Chemically synthesized
caauugcauccuguaccc

SEQ ID NO: 11088 - RNA, 18 nt, artificial
  Chemically synthesized
acagcaaccuuugaaacu

SEQ ID NO: 11089 - RNA, 18 nt, artificial
  Chemically synthesized
gggcucccagcuuucugg

SEQ ID NO: 11090 - RNA, 18 nt, artificial
  Chemically synthesized
uaaggccugacauguggc

SEQ ID NO: 11091 - RNA, 18 nt, artificial
  Chemically synthesized
guaagaguugaaaugacu

SEQ ID NO: 11092 - RNA, 18 nt, artificial
  Chemically synthesized
guaacaaacacuucugac

SEQ ID NO: 11093 - RNA, 18 nt, artificial
  Chemically synthesized
gugagaggaagugaaagc

SEQ ID NO: 11094 - RNA, 18 nt, artificial
  Chemically synthesized
ugucaagguaaaugaggu

SEQ ID NO: 11095 - RNA, 18 nt, artificial
  Chemically synthesized
gggcuaaacucuggaugg

SEQ ID NO: 11096 - RNA, 18 nt, artificial
  Chemically synthesized
uucugugagcagcagugg

SEQ ID NO: 11097 - RNA, 18 nt, artificial
  Chemically synthesized
gcucccagggcuaaacuc

SEQ ID NO: 11098 - RNA, 18 nt, artificial
  Chemically synthesized
uuaagguagagagguggc

SEQ ID NO: 11099 - RNA, 18 nt, artificial
  Chemically synthesized
aagcggcaaccuuagcau

SEQ ID NO: 11100 - RNA, 18 nt, artificial
  Chemically synthesized
acuaguacaugagacaug

SEQ ID NO: 11101 - RNA, 18 nt, artificial
  Chemically synthesized
gaaguuugaacucauggu

SEQ ID NO: 11102 - RNA, 18 nt, artificial
  Chemically synthesized
aaaggaaaaagugaacac

SEQ ID NO: 11103 - RNA, 18 nt, artificial
  Chemically synthesized
uuacucacccuuagcaua

SEQ ID NO: 11104 - RNA, 18 nt, artificial
  Chemically synthesized
uaaagagagauugaguag

SEQ ID NO: 11105 - RNA, 18 nt, artificial
  Chemically synthesized
aaagaaguuguuguggcu

SEQ ID NO: 11106 - RNA, 18 nt, artificial
  Chemically synthesized
ugcaccauggaauuacuc

SEQ ID NO: 11107 - RNA, 18 nt, artificial
  Chemically synthesized
guccaucaaacaucacuu

SEQ ID NO: 11108 - RNA, 18 nt, artificial
  Chemically synthesized
ucaaguuucucagcucug

SEQ ID NO: 11109 - RNA, 18 nt, artificial
  Chemically synthesized
aggcucccagggcuaaac

SEQ ID NO: 11110 - RNA, 18 nt, artificial
  Chemically synthesized
agccaucugugucucccu

SEQ ID NO: 11111 - RNA, 18 nt, artificial
  Chemically synthesized
agauuagcagcccugcau

SEQ ID NO: 11112 - RNA, 18 nt, artificial
  Chemically synthesized
cauucuggacuuuuguuu

SEQ ID NO: 11113 - RNA, 18 nt, artificial
  Chemically synthesized
cuuuugagagauuugagu

SEQ ID NO: 11114 - RNA, 18 nt, artificial
  Chemically synthesized
acaaugucucuuucuguu

SEQ ID NO: 11115 - RNA, 18 nt, artificial
  Chemically synthesized
ucuacuuucacuaguaca

SEQ ID NO: 11116 - RNA, 18 nt, artificial
  Chemically synthesized
ggaaguucucuagagaug

SEQ ID NO: 11117 - RNA, 18 nt, artificial
  Chemically synthesized
ugcucgagaaugaccagg

SEQ ID NO: 11118 - RNA, 18 nt, artificial
  Chemically synthesized
uggaauuacucacccuua

SEQ ID NO: 11119 - RNA, 18 nt, artificial
  Chemically synthesized
gaagugaaaguaagccuu

SEQ ID NO: 11120 - RNA, 18 nt, artificial
  Chemically synthesized
aaauagaacaugcucgag

SEQ ID NO: 11121 - RNA, 18 nt, artificial
  Chemically synthesized
aaauguggucaaggagca

SEQ ID NO: 11122 - RNA, 18 nt, artificial
  Chemically synthesized
cagucaucaaguagaauu

SEQ ID NO: 11123 - RNA, 18 nt, artificial
  Chemically synthesized
aguugacacugagagagg

SEQ ID NO: 11124 - RNA, 18 nt, artificial
  Chemically synthesized
uucauaggguucagggac

SEQ ID NO: 11125 - RNA, 18 nt, artificial
  Chemically synthesized
accuucugcaggacaaug

SEQ ID NO: 11126 - RNA, 18 nt, artificial
  Chemically synthesized
agaaaagucuuuuacccu

SEQ ID NO: 11127 - RNA, 18 nt, artificial
  Chemically synthesized
cuucugugagcagcagug

SEQ ID NO: 11128 - RNA, 18 nt, artificial
  Chemically synthesized
uaacuuuggaaugacauc

SEQ ID NO: 11129 - RNA, 18 nt, artificial
  Chemically synthesized
guaaaugagguuucugag

SEQ ID NO: 11130 - RNA, 18 nt, artificial
  Chemically synthesized
acauggaaacacacccag

SEQ ID NO: 11131 - RNA, 18 nt, artificial
  Chemically synthesized
acaagccauugaagaugc

SEQ ID NO: 11132 - RNA, 18 nt, artificial
  Chemically synthesized
uuucaaugcugcuuucau

SEQ ID NO: 11133 - RNA, 18 nt, artificial
  Chemically synthesized
gagauucagagguccauc

SEQ ID NO: 11134 - RNA, 18 nt, artificial
  Chemically synthesized
augcuguuggagacaacu

SEQ ID NO: 11135 - RNA, 18 nt, artificial
  Chemically synthesized
agagguggcuuaggcucu

SEQ ID NO: 11136 - RNA, 18 nt, artificial
  Chemically synthesized
cacacagcccugauaggg

SEQ ID NO: 11137 - RNA, 18 nt, artificial
  Chemically synthesized
ugagacauggaaacacac

SEQ ID NO: 11138 - RNA, 18 nt, artificial
  Chemically synthesized
cauugcaggaaacucugg

SEQ ID NO: 11139 - RNA, 18 nt, artificial
  Chemically synthesized
acaggugauauucaaacu

SEQ ID NO: 11140 - RNA, 18 nt, artificial
  Chemically synthesized
aauucucccagaaccaaa

SEQ ID NO: 11141 - RNA, 18 nt, artificial
  Chemically synthesized
auaaacuucugcugcaac

SEQ ID NO: 11142 - RNA, 18 nt, artificial
  Chemically synthesized
caugagacauggaaacac

SEQ ID NO: 11143 - RNA, 18 nt, artificial
  Chemically synthesized
auccagauguucuaguug

SEQ ID NO: 11144 - RNA, 18 nt, artificial
  Chemically synthesized
caauuagacaacucccua

SEQ ID NO: 11145 - RNA, 18 nt, artificial
  Chemically synthesized
uacuacaagcacacugag

SEQ ID NO: 11146 - RNA, 18 nt, artificial
  Chemically synthesized
accucuguaaggagacag

SEQ ID NO: 11147 - RNA, 18 nt, artificial
  Chemically synthesized
aacucugguguucacaag

SEQ ID NO: 11148 - RNA, 18 nt, artificial
  Chemically synthesized
guuccuguuuuuuggaag

SEQ ID NO: 11149 - RNA, 18 nt, artificial
  Chemically synthesized
agacaacugcuccaguug

SEQ ID NO: 11150 - RNA, 18 nt, artificial
  Chemically synthesized
cagggaaaaugaagaaac

SEQ ID NO: 11151 - RNA, 18 nt, artificial
  Chemically synthesized
gagaacucaucucaaaca

SEQ ID NO: 11152 - RNA, 18 nt, artificial
  Chemically synthesized
ucuuguugcuggaaaggu

SEQ ID NO: 11153 - RNA, 18 nt, artificial
  Chemically synthesized
agucauuacuuaguaggc

SEQ ID NO: 11154 - RNA, 18 nt, artificial
  Chemically synthesized
caaguuuccuucauuucu

SEQ ID NO: 11155 - RNA, 18 nt, artificial
  Chemically synthesized
aacucagcacaggcaugc

SEQ ID NO: 11156 - RNA, 18 nt, artificial
  Chemically synthesized
cuucugaaaaagcauucc

SEQ ID NO: 11157 - RNA, 18 nt, artificial
  Chemically synthesized
aauccagauguucuaguu

SEQ ID NO: 11158 - RNA, 18 nt, artificial
  Chemically synthesized
aaauaaacuucugcugca

SEQ ID NO: 11159 - RNA, 18 nt, artificial
  Chemically synthesized
acucugaaacacucagua

SEQ ID NO: 11160 - RNA, 18 nt, artificial
  Chemically synthesized
auguauacucccugccuu

SEQ ID NO: 11161 - RNA, 18 nt, artificial
  Chemically synthesized
gagagugaguuaaaugcu

SEQ ID NO: 11162 - RNA, 18 nt, artificial
  Chemically synthesized
auaguccagaaaaggcuc

SEQ ID NO: 11163 - RNA, 18 nt, artificial
  Chemically synthesized
acugcuccaguugacacu

SEQ ID NO: 11164 - RNA, 18 nt, artificial
  Chemically synthesized
gauacauagggauaugug

SEQ ID NO: 11165 - RNA, 18 nt, artificial
  Chemically synthesized
uucugcaggacaaugaag

SEQ ID NO: 11166 - RNA, 18 nt, artificial
  Chemically synthesized
gucugagcaaucucauau

SEQ ID NO: 11167 - RNA, 18 nt, artificial
  Chemically synthesized
aucaacuucugaaaaagc

SEQ ID NO: 11168 - RNA, 18 nt, artificial
  Chemically synthesized
uucaauugucuggauuuc

SEQ ID NO: 11169 - RNA, 18 nt, artificial
  Chemically synthesized
gcucugugaagauaucug

SEQ ID NO: 11170 - RNA, 18 nt, artificial
  Chemically synthesized
ccacaacaaucaccuuuc

SEQ ID NO: 11171 - RNA, 18 nt, artificial
  Chemically synthesized
auaacaaaggcaucauag

SEQ ID NO: 11172 - RNA, 18 nt, artificial
  Chemically synthesized
uuccugcugagaaggcgg

SEQ ID NO: 11173 - RNA, 18 nt, artificial
  Chemically synthesized
guuucugaggcacuggug

SEQ ID NO: 11174 - RNA, 18 nt, artificial
  Chemically synthesized
uagaacccgcaagucugu

SEQ ID NO: 11175 - RNA, 18 nt, artificial
  Chemically synthesized
gaccuugaauacaaguuu

SEQ ID NO: 11176 - RNA, 18 nt, artificial
  Chemically synthesized
uuuuuccucuucagauag

SEQ ID NO: 11177 - RNA, 18 nt, artificial
  Chemically synthesized
gauacaccagcggcucug

SEQ ID NO: 11178 - RNA, 18 nt, artificial
  Chemically synthesized
gcccaagaaguuugaacu

SEQ ID NO: 11179 - RNA, 18 nt, artificial
  Chemically synthesized
agaaaaggcucccagggc

SEQ ID NO: 11180 - RNA, 18 nt, artificial
  Chemically synthesized
uuccuugacugaguuggu

SEQ ID NO: 11181 - RNA, 18 nt, artificial
  Chemically synthesized
cccaggacacuguccucc

SEQ ID NO: 11182 - RNA, 18 nt, artificial
  Chemically synthesized
aacacuucugacuguggu

SEQ ID NO: 11183 - RNA, 18 nt, artificial
  Chemically synthesized
uccacagccaccagcuuc

SEQ ID NO: 11184 - RNA, 18 nt, artificial
  Chemically synthesized
uaugagaaaugucaaggu

SEQ ID NO: 11185 - RNA, 18 nt, artificial
  Chemically synthesized
aacccgcaagucugugca

SEQ ID NO: 11186 - RNA, 18 nt, artificial
  Chemically synthesized
augcggacacacacacuu

SEQ ID NO: 11187 - RNA, 18 nt, artificial
  Chemically synthesized
ggaauuagccacuagacu

SEQ ID NO: 11188 - RNA, 18 nt, artificial
  Chemically synthesized
cuugaguagauaacaaag

SEQ ID NO: 11189 - RNA, 18 nt, artificial
  Chemically synthesized
acgauggacuucuaaacc

SEQ ID NO: 11190 - RNA, 18 nt, artificial
  Chemically synthesized
ucggaauucuucaauggu

SEQ ID NO: 11191 - RNA, 18 nt, artificial
  Chemically synthesized
ucagcacaggcaugcccu

SEQ ID NO: 11192 - RNA, 18 nt, artificial
  Chemically synthesized
cccuuucaauagucacac

SEQ ID NO: 11193 - RNA, 18 nt, artificial
  Chemically synthesized
gacuucuaaaccagccag

SEQ ID NO: 11194 - RNA, 18 nt, artificial
  Chemically synthesized
acuuuuccaaguuuccuu

SEQ ID NO: 11195 - RNA, 18 nt, artificial
  Chemically synthesized
uacaagcacacugaggac

SEQ ID NO: 11196 - RNA, 18 nt, artificial
  Chemically synthesized
uucagauagauguugcuu

SEQ ID NO: 11197 - RNA, 18 nt, artificial
  Chemically synthesized
uggauuucacaccuccac

SEQ ID NO: 11198 - RNA, 18 nt, artificial
  Chemically synthesized
ccuuuugagagauuugag

SEQ ID NO: 11199 - RNA, 18 nt, artificial
  Chemically synthesized
aaacucugguguucacaa

SEQ ID NO: 11200 - RNA, 18 nt, artificial
  Chemically synthesized
cacuucugacugugguca

SEQ ID NO: 11201 - RNA, 18 nt, artificial
  Chemically synthesized
acuucugaaaaagcauuc

SEQ ID NO: 11202 - RNA, 18 nt, artificial
  Chemically synthesized
agaagaaaacgccugcag

SEQ ID NO: 11203 - RNA, 18 nt, artificial
  Chemically synthesized
aacacucaguaacaaaca

SEQ ID NO: 11204 - RNA, 18 nt, artificial
  Chemically synthesized
caucauccucacugcuuc

SEQ ID NO: 11205 - RNA, 18 nt, artificial
  Chemically synthesized
aaaauagaacaugcucga

SEQ ID NO: 11206 - RNA, 18 nt, artificial
  Chemically synthesized
ugaaaaagcauucccacc

SEQ ID NO: 11207 - RNA, 18 nt, artificial
  Chemically synthesized
auucuuuucugggaaccu

SEQ ID NO: 11208 - RNA, 18 nt, artificial
  Chemically synthesized
caacaggaaacagcaaug

SEQ ID NO: 11209 - RNA, 18 nt, artificial
  Chemically synthesized
gauuucacaccuccacgc

SEQ ID NO: 11210 - RNA, 18 nt, artificial
  Chemically synthesized
auacaccagcggcucugg

SEQ ID NO: 11211 - RNA, 18 nt, artificial
  Chemically synthesized
caggaagcggaaauuuuc

SEQ ID NO: 11212 - RNA, 18 nt, artificial
  Chemically synthesized
guguauucaaagcaguuc

SEQ ID NO: 11213 - RNA, 18 nt, artificial
  Chemically synthesized
ucuguaaggagacagacu

SEQ ID NO: 11214 - RNA, 18 nt, artificial
  Chemically synthesized
cagcaauguauacucccu

SEQ ID NO: 11215 - RNA, 18 nt, artificial
  Chemically synthesized
caaccuuagcauucugga

SEQ ID NO: 11216 - RNA, 18 nt, artificial
  Chemically synthesized
cacugagagagguccagg

SEQ ID NO: 11217 - RNA, 18 nt, artificial
  Chemically synthesized
caguggcuaaagaaacag

SEQ ID NO: 11218 - RNA, 18 nt, artificial
  Chemically synthesized
auacuuuaugcagccagc

SEQ ID NO: 11219 - RNA, 18 nt, artificial
  Chemically synthesized
uuccauucguucaacuuc

SEQ ID NO: 11220 - RNA, 18 nt, artificial
  Chemically synthesized
ucugugucucccuaaaga

SEQ ID NO: 11221 - RNA, 18 nt, artificial
  Chemically synthesized
aauguugccauccgaaau

SEQ ID NO: 11222 - RNA, 18 nt, artificial
  Chemically synthesized
acugcagucaucaaguag

SEQ ID NO: 11223 - RNA, 18 nt, artificial
  Chemically synthesized
cuggcuugaguagauaac

SEQ ID NO: 11224 - RNA, 18 nt, artificial
  Chemically synthesized
uaaguaugcuaaucggaa

SEQ ID NO: 11225 - RNA, 18 nt, artificial
  Chemically synthesized
agcucagaucuaaauacu

SEQ ID NO: 11226 - RNA, 18 nt, artificial
  Chemically synthesized
gcuuuuauggaaaccuuc

SEQ ID NO: 11227 - RNA, 18 nt, artificial
  Chemically synthesized
gagacuacuguacaagca

SEQ ID NO: 11228 - RNA, 18 nt, artificial
  Chemically synthesized
agcaaccuuugaaacuca

SEQ ID NO: 11229 - RNA, 18 nt, artificial
  Chemically synthesized
aaaugguuuuaugauggc

SEQ ID NO: 11230 - RNA, 18 nt, artificial
  Chemically synthesized
acucugguguucacaagu

SEQ ID NO: 11231 - RNA, 18 nt, artificial
  Chemically synthesized
ugaaaacucacucauuug

SEQ ID NO: 11232 - RNA, 18 nt, artificial
  Chemically synthesized
agccuuuugagagauuug

SEQ ID NO: 11233 - RNA, 18 nt, artificial
  Chemically synthesized
auaccagcacgacugcuc

SEQ ID NO: 11234 - RNA, 18 nt, artificial
  Chemically synthesized
uggguuccuugacugagu

SEQ ID NO: 11235 - RNA, 18 nt, artificial
  Chemically synthesized
aaacucaagccauuucua

SEQ ID NO: 11236 - RNA, 18 nt, artificial
  Chemically synthesized
gauuggucagauuagaaa

SEQ ID NO: 11237 - RNA, 18 nt, artificial
  Chemically synthesized
aaaccaaacacacucuga

SEQ ID NO: 11238 - RNA, 18 nt, artificial
  Chemically synthesized
cagauaugaucaugcgga

SEQ ID NO: 11239 - RNA, 18 nt, artificial
  Chemically synthesized
gcuuuucugagucgucuc

SEQ ID NO: 11240 - RNA, 18 nt, artificial
  Chemically synthesized
ggugauauucaaacucag

SEQ ID NO: 11241 - RNA, 18 nt, artificial
  Chemically synthesized
agucauuaugugauugag

SEQ ID NO: 11242 - RNA, 18 nt, artificial
  Chemically synthesized
ccaggacacuguccuccc

SEQ ID NO: 11243 - RNA, 18 nt, artificial
  Chemically synthesized
uccacucuucccaaaaug

SEQ ID NO: 11244 - RNA, 18 nt, artificial
  Chemically synthesized
cauucccaccuuuguugg

SEQ ID NO: 11245 - RNA, 18 nt, artificial
  Chemically synthesized
acugaguugguugaaaug

SEQ ID NO: 11246 - RNA, 18 nt, artificial
  Chemically synthesized
ggaaggucaaguuucuca

SEQ ID NO: 11247 - RNA, 18 nt, artificial
  Chemically synthesized
gaccagaacugcuacaac

SEQ ID NO: 11248 - RNA, 18 nt, artificial
  Chemically synthesized
aaguguuggacccagcug

SEQ ID NO: 11249 - RNA, 18 nt, artificial
  Chemically synthesized
uguguuaaucagguuucc

SEQ ID NO: 11250 - RNA, 18 nt, artificial
  Chemically synthesized
aaugcugcuuucaugaca

SEQ ID NO: 11251 - RNA, 18 nt, artificial
  Chemically synthesized
uucaauggucaaauugca

SEQ ID NO: 11252 - RNA, 18 nt, artificial
  Chemically synthesized
uaaaguucauaggguuca

SEQ ID NO: 11253 - RNA, 18 nt, artificial
  Chemically synthesized
cauccagcagggcuuuuc

SEQ ID NO: 11254 - RNA, 18 nt, artificial
  Chemically synthesized
ggagacuacuguacaagc

SEQ ID NO: 11255 - RNA, 18 nt, artificial
  Chemically synthesized
auuccagacacauuguuu

SEQ ID NO: 11256 - RNA, 18 nt, artificial
  Chemically synthesized
cuuugaaacucaagccau

SEQ ID NO: 11257 - RNA, 18 nt, artificial
  Chemically synthesized
caaaugcacacaucuacu

SEQ ID NO: 11258 - RNA, 18 nt, artificial
  Chemically synthesized
aggaaggucaaguuucuc

SEQ ID NO: 11259 - RNA, 18 nt, artificial
  Chemically synthesized
cauucuuuucugggaacc

SEQ ID NO: 11260 - RNA, 18 nt, artificial
  Chemically synthesized
cacucucuucuauacaga

SEQ ID NO: 11261 - RNA, 18 nt, artificial
  Chemically synthesized
agaggaaggccauggcug

SEQ ID NO: 11262 - RNA, 18 nt, artificial
  Chemically synthesized
caccaaugauggucuuau

SEQ ID NO: 11263 - RNA, 18 nt, artificial
  Chemically synthesized
aguagauaacaaaggcau

SEQ ID NO: 11264 - RNA, 18 nt, artificial
  Chemically synthesized
cuguuggagacaacugcu

SEQ ID NO: 11265 - RNA, 18 nt, artificial
  Chemically synthesized
uaaacuugauaguccaga

SEQ ID NO: 11266 - RNA, 18 nt, artificial
  Chemically synthesized
ugauaacauccacucuuc

SEQ ID NO: 11267 - RNA, 18 nt, artificial
  Chemically synthesized
uggaugaacauucuuuuc

SEQ ID NO: 11268 - RNA, 18 nt, artificial
  Chemically synthesized
gagagguggcuuaggcuc

SEQ ID NO: 11269 - RNA, 18 nt, artificial
  Chemically synthesized
guguugcacauuccauuc

SEQ ID NO: 11270 - RNA, 18 nt, artificial
  Chemically synthesized
acacacccagggauguuc

SEQ ID NO: 11271 - RNA, 18 nt, artificial
  Chemically synthesized
agcaguucugggcuaaag

SEQ ID NO: 11272 - RNA, 18 nt, artificial
  Chemically synthesized
uuaacugaacaaguguug

SEQ ID NO: 11273 - RNA, 18 nt, artificial
  Chemically synthesized
ggucaucccacuuccuuc

SEQ ID NO: 11274 - RNA, 18 nt, artificial
  Chemically synthesized
gaauugccagccauuuuc

SEQ ID NO: 11275 - RNA, 18 nt, artificial
  Chemically synthesized
auaaggccugacaugugg

SEQ ID NO: 11276 - RNA, 18 nt, artificial
  Chemically synthesized
uaaauguugccauccgaa

SEQ ID NO: 11277 - RNA, 18 nt, artificial
  Chemically synthesized
gaauacugaaaacucacu

SEQ ID NO: 11278 - RNA, 18 nt, artificial
  Chemically synthesized
ggucaaguuucucagcuc

SEQ ID NO: 11279 - RNA, 18 nt, artificial
  Chemically synthesized
uucuuuucugggaaccuu

SEQ ID NO: 11280 - RNA, 18 nt, artificial
  Chemically synthesized
uuugagaacagcaaccuu

SEQ ID NO: 11281 - RNA, 18 nt, artificial
  Chemically synthesized
aggcgguacagcuccacc

SEQ ID NO: 11282 - RNA, 18 nt, artificial
  Chemically synthesized
caguuuugacaacugaau

SEQ ID NO: 11283 - RNA, 18 nt, artificial
  Chemically synthesized
uugaaaugcccaccugga

SEQ ID NO: 11284 - RNA, 18 nt, artificial
  Chemically synthesized
caggucugagcaaucuca

SEQ ID NO: 11285 - RNA, 18 nt, artificial
  Chemically synthesized
uuucucccuuccuccuuu

SEQ ID NO: 11286 - RNA, 18 nt, artificial
  Chemically synthesized
gugaguuaaaugcuguug

SEQ ID NO: 11287 - RNA, 18 nt, artificial
  Chemically synthesized
cugccuugaauaccuuca

SEQ ID NO: 11288 - RNA, 18 nt, artificial
  Chemically synthesized
ccugauagggauacauag

SEQ ID NO: 11289 - RNA, 18 nt, artificial
  Chemically synthesized
acucagcacaggcaugcc

SEQ ID NO: 11290 - RNA, 18 nt, artificial
  Chemically synthesized
cucagaaacugccagguc

SEQ ID NO: 11291 - RNA, 18 nt, artificial
  Chemically synthesized
cugcucagaaacugccag

SEQ ID NO: 11292 - RNA, 18 nt, artificial
  Chemically synthesized
aguuaaaugcuguuggag

SEQ ID NO: 11293 - RNA, 18 nt, artificial
  Chemically synthesized
auccagcagggcuuuucu

SEQ ID NO: 11294 - RNA, 18 nt, artificial
  Chemically synthesized
augccauugaaagcaacu

SEQ ID NO: 11295 - RNA, 18 nt, artificial
  Chemically synthesized
ucaacuucugaaaaagca

SEQ ID NO: 11296 - RNA, 18 nt, artificial
  Chemically synthesized
ucuaccauacuuuaugca

SEQ ID NO: 11297 - RNA, 18 nt, artificial
  Chemically synthesized
uacuuuuccauacuuccu

SEQ ID NO: 11298 - RNA, 18 nt, artificial
  Chemically synthesized
cacucuucccaaaaugug

SEQ ID NO: 11299 - RNA, 18 nt, artificial
  Chemically synthesized
uugaugagguaagaguug

SEQ ID NO: 11300 - RNA, 18 nt, artificial
  Chemically synthesized
ucugguccuugauccauu

SEQ ID NO: 11301 - RNA, 18 nt, artificial
  Chemically synthesized
gucaaauugcacaggccc

SEQ ID NO: 11302 - RNA, 18 nt, artificial
  Chemically synthesized
gaaacucugguguucaca

SEQ ID NO: 11303 - RNA, 18 nt, artificial
  Chemically synthesized
ccagcuuucuggucucac

SEQ ID NO: 11304 - RNA, 18 nt, artificial
  Chemically synthesized
cugcuuucaugacaguca

SEQ ID NO: 11305 - RNA, 18 nt, artificial
  Chemically synthesized
uuguuguggcucauauuu

SEQ ID NO: 11306 - RNA, 18 nt, artificial
  Chemically synthesized
caagcacacugaggaccg

SEQ ID NO: 11307 - RNA, 18 nt, artificial
  Chemically synthesized
aagccauuucuacugaga

SEQ ID NO: 11308 - RNA, 18 nt, artificial
  Chemically synthesized
cuuucaaauacacacagc

SEQ ID NO: 11309 - RNA, 18 nt, artificial
  Chemically synthesized
uguucuguuucugaggag

SEQ ID NO: 11310 - RNA, 18 nt, artificial
  Chemically synthesized
ccagaacugcuacaacag

SEQ ID NO: 11311 - RNA, 18 nt, artificial
  Chemically synthesized
ccuucacacguaguucuc

SEQ ID NO: 11312 - RNA, 18 nt, artificial
  Chemically synthesized
gugauaggaauacugaaa

SEQ ID NO: 11313 - RNA, 18 nt, artificial
  Chemically synthesized
uagauaacaaaggcauca

SEQ ID NO: 11314 - RNA, 18 nt, artificial
  Chemically synthesized
agguuucugagugauagg

SEQ ID NO: 11315 - RNA, 18 nt, artificial
  Chemically synthesized
ccuuugaaacucaagcca

SEQ ID NO: 11316 - RNA, 18 nt, artificial
  Chemically synthesized
acagucauuacuuaguag

SEQ ID NO: 11317 - RNA, 18 nt, artificial
  Chemically synthesized
aggcuggaugaacauucu

SEQ ID NO: 11318 - RNA, 18 nt, artificial
  Chemically synthesized
acagcaauugguguauuc

SEQ ID NO: 11319 - RNA, 18 nt, artificial
  Chemically synthesized
acuacuuggaaaaugcug

SEQ ID NO: 11320 - RNA, 18 nt, artificial
  Chemically synthesized
agggcucccagcuuucug

SEQ ID NO: 11321 - RNA, 18 nt, artificial
  Chemically synthesized
gaagugaaagcggcaacc

SEQ ID NO: 11322 - RNA, 18 nt, artificial
  Chemically synthesized
cuacuuggaaaaugcugu

SEQ ID NO: 11323 - RNA, 18 nt, artificial
  Chemically synthesized
ucacuuugagaacagcaa

SEQ ID NO: 11324 - RNA, 18 nt, artificial
  Chemically synthesized
acuuucaaauacacacag

SEQ ID NO: 11325 - RNA, 18 nt, artificial
  Chemically synthesized
ggacaggucuaaagagag

SEQ ID NO: 11326 - RNA, 18 nt, artificial
  Chemically synthesized
uuugaagcacgucuuaaa

SEQ ID NO: 11327 - RNA, 18 nt, artificial
  Chemically synthesized
ucccagcuuucuggucuc

SEQ ID NO: 11328 - RNA, 18 nt, artificial
  Chemically synthesized
uacucccugccuugaaua

SEQ ID NO: 11329 - RNA, 18 nt, artificial
  Chemically synthesized
ucugcacuggaagcuccu

SEQ ID NO: 11330 - RNA, 18 nt, artificial
  Chemically synthesized
uccagauguucuaguugu

SEQ ID NO: 11331 - RNA, 18 nt, artificial
  Chemically synthesized
ugcccugcuuaucugaag

SEQ ID NO: 11332 - RNA, 18 nt, artificial
  Chemically synthesized
uuuacuagcucauuccuu

SEQ ID NO: 11333 - RNA, 18 nt, artificial
  Chemically synthesized
aguuagaagaagaaaacg

SEQ ID NO: 11334 - RNA, 18 nt, artificial
  Chemically synthesized
gaggaaguuagaagaaga

SEQ ID NO: 11335 - RNA, 18 nt, artificial
  Chemically synthesized
gugugaguaugagaaaug

SEQ ID NO: 11336 - RNA, 18 nt, artificial
  Chemically synthesized
cagcaagaagcaucaggu

SEQ ID NO: 11337 - RNA, 18 nt, artificial
  Chemically synthesized
uuguggcucauauuuagu

SEQ ID NO: 11338 - RNA, 18 nt, artificial
  Chemically synthesized
cacuuauaaggaaacgua

SEQ ID NO: 11339 - RNA, 18 nt, artificial
  Chemically synthesized
cagccagaccuugaauac

SEQ ID NO: 11340 - RNA, 18 nt, artificial
  Chemically synthesized
ugauaagaccaggaagcg

SEQ ID NO: 11341 - RNA, 18 nt, artificial
  Chemically synthesized
ugagcaaucucauauuca

SEQ ID NO: 11342 - RNA, 18 nt, artificial
  Chemically synthesized
cacucugaaacacucagu

SEQ ID NO: 11343 - RNA, 18 nt, artificial
  Chemically synthesized
gacacuguccucccacuc

SEQ ID NO: 11344 - RNA, 18 nt, artificial
  Chemically synthesized
caugauaagaccaggaag

SEQ ID NO: 11345 - RNA, 18 nt, artificial
  Chemically synthesized
ugaaaguaagccuuuuga

SEQ ID NO: 11346 - RNA, 18 nt, artificial
  Chemically synthesized
gaacugcuacaacagaua

SEQ ID NO: 11347 - RNA, 18 nt, artificial
  Chemically synthesized
uggcuuaggcucugauau

SEQ ID NO: 11348 - RNA, 18 nt, artificial
  Chemically synthesized
acuguccaaauuuacagu

SEQ ID NO: 11349 - RNA, 18 nt, artificial
  Chemically synthesized
auuggaaugcuggaaauc

SEQ ID NO: 11350 - RNA, 18 nt, artificial
  Chemically synthesized
uccugauuguccuuuucu

SEQ ID NO: 11351 - RNA, 18 nt, artificial
  Chemically synthesized
aucucaaacagccauaga

SEQ ID NO: 11352 - RNA, 18 nt, artificial
  Chemically synthesized
cuggaugaacauucuuuu

SEQ ID NO: 11353 - RNA, 18 nt, artificial
  Chemically synthesized
accuuuguuggaagugaa

SEQ ID NO: 11354 - RNA, 18 nt, artificial
  Chemically synthesized
ucauccucacugcuucug

SEQ ID NO: 11355 - RNA, 18 nt, artificial
  Chemically synthesized
cagugagaaggguacagg

SEQ ID NO: 11356 - RNA, 18 nt, artificial
  Chemically synthesized
aagguccaagugcucuag

SEQ ID NO: 11357 - RNA, 18 nt, artificial
  Chemically synthesized
ucccuauuuccucauuuc

SEQ ID NO: 11358 - RNA, 18 nt, artificial
  Chemically synthesized
ugaccaggaugguuguga

SEQ ID NO: 11359 - RNA, 18 nt, artificial
  Chemically synthesized
aaggcaucauagauguuu

SEQ ID NO: 11360 - RNA, 18 nt, artificial
  Chemically synthesized
ugguugucccaaaaucac

SEQ ID NO: 11361 - RNA, 18 nt, artificial
  Chemically synthesized
cuuugaaucuuguugcug

SEQ ID NO: 11362 - RNA, 18 nt, artificial
  Chemically synthesized
agaccaguggcuaaagaa

SEQ ID NO: 11363 - RNA, 18 nt, artificial
  Chemically synthesized
ucccacuuccuuccugcc

SEQ ID NO: 11364 - RNA, 18 nt, artificial
  Chemically synthesized
acacucaguaacaaacac

SEQ ID NO: 11365 - RNA, 18 nt, artificial
  Chemically synthesized
caagcacaagaguagaga

SEQ ID NO: 11366 - RNA, 18 nt, artificial
  Chemically synthesized
gaguugaaaugacuuucu

SEQ ID NO: 11367 - RNA, 18 nt, artificial
  Chemically synthesized
acucaguaacaaacacuu

SEQ ID NO: 11368 - RNA, 18 nt, artificial
  Chemically synthesized
ucaucgagguaguagucu

SEQ ID NO: 11369 - RNA, 18 nt, artificial
  Chemically synthesized
augauaacauccacucuu

SEQ ID NO: 11370 - RNA, 18 nt, artificial
  Chemically synthesized
aggacacuguccucccac

SEQ ID NO: 11371 - RNA, 18 nt, artificial
  Chemically synthesized
uccagaaaaggcucccag

SEQ ID NO: 11372 - RNA, 18 nt, artificial
  Chemically synthesized
aacugcuccaguugacac

SEQ ID NO: 11373 - RNA, 18 nt, artificial
  Chemically synthesized
aguugguugaaaugccca

SEQ ID NO: 11374 - RNA, 18 nt, artificial
  Chemically synthesized
cccucuagagcagauuug

SEQ ID NO: 11375 - RNA, 18 nt, artificial
  Chemically synthesized
uagaacuuauagaccaga

SEQ ID NO: 11376 - RNA, 18 nt, artificial
  Chemically synthesized
ugagguaagaguugaaau

SEQ ID NO: 11377 - RNA, 18 nt, artificial
  Chemically synthesized
uuaaaugcuguuggagac

SEQ ID NO: 11378 - RNA, 18 nt, artificial
  Chemically synthesized
uuuucugggaaccuucuu

SEQ ID NO: 11379 - RNA, 18 nt, artificial
  Chemically synthesized
auccauuucaaauggaug

SEQ ID NO: 11380 - RNA, 18 nt, artificial
  Chemically synthesized
acuguggucauauuucca

SEQ ID NO: 11381 - RNA, 18 nt, artificial
  Chemically synthesized
agaaguuguuguggcuca

SEQ ID NO: 11382 - RNA, 18 nt, artificial
  Chemically synthesized
uugcccaacaggaaacag

SEQ ID NO: 11383 - RNA, 18 nt, artificial
  Chemically synthesized
gugcucuagauuggucag

SEQ ID NO: 11384 - RNA, 18 nt, artificial
  Chemically synthesized
gacauggaaacacaccca

SEQ ID NO: 11385 - RNA, 18 nt, artificial
  Chemically synthesized
aaugcuguaguuccuguu

SEQ ID NO: 11386 - RNA, 18 nt, artificial
  Chemically synthesized
cuuuaugcagccagcaag

SEQ ID NO: 11387 - RNA, 18 nt, artificial
  Chemically synthesized
auccuggcuugaguagau

SEQ ID NO: 11388 - RNA, 18 nt, artificial
  Chemically synthesized
ccaaacacacucugaaac

SEQ ID NO: 11389 - RNA, 18 nt, artificial
  Chemically synthesized
cuggcaucauccucacug

SEQ ID NO: 11390 - RNA, 18 nt, artificial
  Chemically synthesized
uaaaugagguuucugagu

SEQ ID NO: 11391 - RNA, 18 nt, artificial
  Chemically synthesized
gcacaagaguagagaacu

SEQ ID NO: 11392 - RNA, 18 nt, artificial
  Chemically synthesized
aaugcguggcucgcuauc

SEQ ID NO: 11393 - RNA, 18 nt, artificial
  Chemically synthesized
ccucuagcccaaauuguc

SEQ ID NO: 11394 - RNA, 18 nt, artificial
  Chemically synthesized
cauucaaaagacucagga

SEQ ID NO: 11395 - RNA, 18 nt, artificial
  Chemically synthesized
gaacagcaaccuuugaaa

SEQ ID NO: 11396 - RNA, 18 nt, artificial
  Chemically synthesized
uguacaagcacaagagua

SEQ ID NO: 11397 - RNA, 18 nt, artificial
  Chemically synthesized
aaugcuguuggagacaac

SEQ ID NO: 11398 - RNA, 18 nt, artificial
  Chemically synthesized
aagcuagacuacuuggaa

SEQ ID NO: 11399 - RNA, 18 nt, artificial
  Chemically synthesized
aggcagacaucauccugg

SEQ ID NO: 11400 - RNA, 18 nt, artificial
  Chemically synthesized
caucaaacaucacuuguu

SEQ ID NO: 11401 - RNA, 18 nt, artificial
  Chemically synthesized
guaccugaagacuggaga

SEQ ID NO: 11402 - RNA, 18 nt, artificial
  Chemically synthesized
caggaaacagcaauguau

SEQ ID NO: 11403 - RNA, 18 nt, artificial
  Chemically synthesized
aaagucuuuuacccuuuc

SEQ ID NO: 11404 - RNA, 18 nt, artificial
  Chemically synthesized
caacagauacuacaagca

SEQ ID NO: 11405 - RNA, 18 nt, artificial
  Chemically synthesized
ucaggaaaagaacaaugu

SEQ ID NO: 11406 - RNA, 18 nt, artificial
  Chemically synthesized
cacucaccagggaaaaug

SEQ ID NO: 11407 - RNA, 18 nt, artificial
  Chemically synthesized
ccagcuucuguaaacuug

SEQ ID NO: 11408 - RNA, 18 nt, artificial
  Chemically synthesized
gcacgucuuaaacaaccu

SEQ ID NO: 11409 - RNA, 18 nt, artificial
  Chemically synthesized
uacuuuaggcugguuguc

SEQ ID NO: 11410 - RNA, 18 nt, artificial
  Chemically synthesized
gcaauguauacucccugc

SEQ ID NO: 11411 - RNA, 18 nt, artificial
  Chemically synthesized
auggucuuauucaucuga

SEQ ID NO: 11412 - RNA, 18 nt, artificial
  Chemically synthesized
acucaaggcuugguagau

SEQ ID NO: 11413 - RNA, 18 nt, artificial
  Chemically synthesized
agccauagacauccauuu

SEQ ID NO: 11414 - RNA, 18 nt, artificial
  Chemically synthesized
gggaauaaagucucugua

SEQ ID NO: 11415 - RNA, 18 nt, artificial
  Chemically synthesized
aaaaagugaacacccagu

SEQ ID NO: 11416 - RNA, 18 nt, artificial
  Chemically synthesized
cugaacaaguguuggacc

SEQ ID NO: 11417 - RNA, 18 nt, artificial
  Chemically synthesized
uagcauuuauucccucug

SEQ ID NO: 11418 - RNA, 18 nt, artificial
  Chemically synthesized
auccuggcaucauccuca

SEQ ID NO: 11419 - RNA, 18 nt, artificial
  Chemically synthesized
guagagagguggcuuagg

SEQ ID NO: 11420 - RNA, 18 nt, artificial
  Chemically synthesized
caagaaguuugaacucau

SEQ ID NO: 11421 - RNA, 18 nt, artificial
  Chemically synthesized
ucuagcauuuauucccuc

SEQ ID NO: 11422 - RNA, 18 nt, artificial
  Chemically synthesized
agccauugaagaugccau

SEQ ID NO: 11423 - RNA, 18 nt, artificial
  Chemically synthesized
agcacacugaggaccgac

SEQ ID NO: 11424 - RNA, 18 nt, artificial
  Chemically synthesized
uacagcuccaccugcugc

SEQ ID NO: 11425 - RNA, 18 nt, artificial
  Chemically synthesized
ugguugugagcauguguu

SEQ ID NO: 11426 - RNA, 18 nt, artificial
  Chemically synthesized
uugugagcauguguuaau

SEQ ID NO: 11427 - RNA, 18 nt, artificial
  Chemically synthesized
uuaucugaagguguugca

SEQ ID NO: 11428 - RNA, 18 nt, artificial
  Chemically synthesized
ucagcucugugaagauau

SEQ ID NO: 11429 - RNA, 18 nt, artificial
  Chemically synthesized
cagccaccagcuucugua

SEQ ID NO: 11430 - RNA, 18 nt, artificial
  Chemically synthesized
cuguggucauauuuccag

SEQ ID NO: 11431 - RNA, 18 nt, artificial
  Chemically synthesized
agugagaaggguacaggg

SEQ ID NO: 11432 - RNA, 18 nt, artificial
  Chemically synthesized
aagagauucagaggucca

SEQ ID NO: 11433 - RNA, 18 nt, artificial
  Chemically synthesized
aaugcaccugguuggaua

SEQ ID NO: 11434 - RNA, 18 nt, artificial
  Chemically synthesized
caagugcucuagauuggu

SEQ ID NO: 11435 - RNA, 18 nt, artificial
  Chemically synthesized
aggucugagcaaucucau

SEQ ID NO: 11436 - RNA, 18 nt, artificial
  Chemically synthesized
gcaucuugcaucaggagc

SEQ ID NO: 11437 - RNA, 18 nt, artificial
  Chemically synthesized
aacugcuacaacagauac

SEQ ID NO: 11438 - RNA, 18 nt, artificial
  Chemically synthesized
agugacaaagugacagag

SEQ ID NO: 11439 - RNA, 18 nt, artificial
  Chemically synthesized
auguugccauccgaaauu

SEQ ID NO: 11440 - RNA, 18 nt, artificial
  Chemically synthesized
gaaauccagauguucuag

SEQ ID NO: 11441 - RNA, 18 nt, artificial
  Chemically synthesized
gagguaguagucuaagua

SEQ ID NO: 11442 - RNA, 18 nt, artificial
  Chemically synthesized
accacaacaaucaccuuu

SEQ ID NO: 11443 - RNA, 18 nt, artificial
  Chemically synthesized
augacuuucuuugucaug

SEQ ID NO: 11444 - RNA, 18 nt, artificial
  Chemically synthesized
cugagaaggcgguacagc

SEQ ID NO: 11445 - RNA, 18 nt, artificial
  Chemically synthesized
aacucuggugugaguaug

SEQ ID NO: 11446 - RNA, 18 nt, artificial
  Chemically synthesized
uuaaucagguuuccuuag

SEQ ID NO: 11447 - RNA, 18 nt, artificial
  Chemically synthesized
ucgagguaguagucuaag

SEQ ID NO: 11448 - RNA, 18 nt, artificial
  Chemically synthesized
uccagcagggcuuuucug

SEQ ID NO: 11449 - RNA, 18 nt, artificial
  Chemically synthesized
uaugugcacaaaugcaca

SEQ ID NO: 11450 - RNA, 18 nt, artificial
  Chemically synthesized
uucagacacuuauaagga

SEQ ID NO: 11451 - RNA, 18 nt, artificial
  Chemically synthesized
uguaaucaagaaccugga

SEQ ID NO: 11452 - RNA, 18 nt, artificial
  Chemically synthesized
auaucuggaaggaaguuu

SEQ ID NO: 11453 - RNA, 18 nt, artificial
  Chemically synthesized
ugcuggaaauccagaugu

SEQ ID NO: 11454 - RNA, 18 nt, artificial
  Chemically synthesized
augcccaccuggaagacu

SEQ ID NO: 11455 - RNA, 18 nt, artificial
  Chemically synthesized
acaacugcuccaguugac

SEQ ID NO: 11456 - RNA, 18 nt, artificial
  Chemically synthesized
uucucccagaaccaaacg

SEQ ID NO: 11457 - RNA, 18 nt, artificial
  Chemically synthesized
acacugagagagguccag

SEQ ID NO: 11458 - RNA, 18 nt, artificial
  Chemically synthesized
gcgaggcagacaucaucc

SEQ ID NO: 11459 - RNA, 18 nt, artificial
  Chemically synthesized
cauggaaacacacccagg

SEQ ID NO: 11460 - RNA, 18 nt, artificial
  Chemically synthesized
caagcaaagucauucuga

SEQ ID NO: 11461 - RNA, 18 nt, artificial
  Chemically synthesized
aguaugagaaaugucaag

SEQ ID NO: 11462 - RNA, 18 nt, artificial
  Chemically synthesized
aaacucagcacaggcaug

SEQ ID NO: 11463 - RNA, 18 nt, artificial
  Chemically synthesized
cuggaaagaauugccagc

SEQ ID NO: 11464 - RNA, 18 nt, artificial
  Chemically synthesized
uuagcagcccugcauauc

SEQ ID NO: 11465 - RNA, 18 nt, artificial
  Chemically synthesized
ugcucuagauuggucaga

SEQ ID NO: 11466 - RNA, 18 nt, artificial
  Chemically synthesized
cagauguucuaguuguuc

SEQ ID NO: 11467 - RNA, 18 nt, artificial
  Chemically synthesized
uuugaaacucaagccauu

SEQ ID NO: 11468 - RNA, 18 nt, artificial
  Chemically synthesized
agucauucugaguaagau

SEQ ID NO: 11469 - RNA, 18 nt, artificial
  Chemically synthesized
ugcuacaacagauacuac

SEQ ID NO: 11470 - RNA, 18 nt, artificial
  Chemically synthesized
aacagauacuacaagcac

SEQ ID NO: 11471 - RNA, 18 nt, artificial
  Chemically synthesized
agcucugugaagauaucu

SEQ ID NO: 11472 - RNA, 18 nt, artificial
  Chemically synthesized
uggacaagccauugaaga

SEQ ID NO: 11473 - RNA, 18 nt, artificial
  Chemically synthesized
cauccuguacccacuguu

SEQ ID NO: 11474 - RNA, 18 nt, artificial
  Chemically synthesized
aaaugcccaccuggaaga

SEQ ID NO: 11475 - RNA, 18 nt, artificial
  Chemically synthesized
gauuggauaagauuguga

SEQ ID NO: 11476 - RNA, 18 nt, artificial
  Chemically synthesized
aggaaacucugguguuca

SEQ ID NO: 11477 - RNA, 18 nt, artificial
  Chemically synthesized
auaagauugugagccaca

SEQ ID NO: 11478 - RNA, 18 nt, artificial
  Chemically synthesized
ucccagccaucugugucu

SEQ ID NO: 11479 - RNA, 18 nt, artificial
  Chemically synthesized
augcguggcucgcuauca

SEQ ID NO: 11480 - RNA, 18 nt, artificial
  Chemically synthesized
gguguugcacauuccauu

SEQ ID NO: 11481 - RNA, 18 nt, artificial
  Chemically synthesized
cuuaugaagccuaauuuc

SEQ ID NO: 11482 - RNA, 18 nt, artificial
  Chemically synthesized
aaaagacucaggaaaaga

SEQ ID NO: 11483 - RNA, 18 nt, artificial
  Chemically synthesized
uccaugauaagaccagga

SEQ ID NO: 11484 - RNA, 18 nt, artificial
  Chemically synthesized
aaaagugaacacccaguu

SEQ ID NO: 11485 - RNA, 18 nt, artificial
  Chemically synthesized
ugauguuggcagcaaugg

SEQ ID NO: 11486 - RNA, 18 nt, artificial
  Chemically synthesized
caagucugugcaauaaau

SEQ ID NO: 11487 - RNA, 18 nt, artificial
  Chemically synthesized
uguugcacauuccauucg

SEQ ID NO: 11488 - RNA, 18 nt, artificial
  Chemically synthesized
cuggugucuucucuuccu

SEQ ID NO: 11489 - RNA, 18 nt, artificial
  Chemically synthesized
uggauguauucuucaaga

SEQ ID NO: 11490 - RNA, 18 nt, artificial
  Chemically synthesized
cauuccauucguucaacu

SEQ ID NO: 11491 - RNA, 18 nt, artificial
  Chemically synthesized
acacacuuucaaauacac

SEQ ID NO: 11492 - RNA, 18 nt, artificial
  Chemically synthesized
ugggacaccacaacaauc

SEQ ID NO: 11493 - RNA, 18 nt, artificial
  Chemically synthesized
aguccucauccuggcuug

SEQ ID NO: 11494 - RNA, 18 nt, artificial
  Chemically synthesized
uagcuucauucagacaua

SEQ ID NO: 11495 - RNA, 18 nt, artificial
  Chemically synthesized
uuauucaucugacaggug

SEQ ID NO: 11496 - RNA, 18 nt, artificial
  Chemically synthesized
ucaucucaaacagccaua

SEQ ID NO: 11497 - RNA, 18 nt, artificial
  Chemically synthesized
ugaaaagaaguuguugug

SEQ ID NO: 11498 - RNA, 18 nt, artificial
  Chemically synthesized
ugacagucauuacuuagu

SEQ ID NO: 11499 - RNA, 18 nt, artificial
  Chemically synthesized
ucaccagggaaaaugaag

SEQ ID NO: 11500 - RNA, 18 nt, artificial
  Chemically synthesized
ccacuuccuuccugccuc

SEQ ID NO: 11501 - RNA, 18 nt, artificial
  Chemically synthesized
ggcuuuucugagucgucu

SEQ ID NO: 11502 - RNA, 18 nt, artificial
  Chemically synthesized
cucaugguaauaacacca

SEQ ID NO: 11503 - RNA, 18 nt, artificial
  Chemically synthesized
gacuguaaucaagaaccu

SEQ ID NO: 11504 - RNA, 18 nt, artificial
  Chemically synthesized
aacuugaugagguaagag

SEQ ID NO: 11505 - RNA, 18 nt, artificial
  Chemically synthesized
agauacaccagcggcucu

SEQ ID NO: 11506 - RNA, 18 nt, artificial
  Chemically synthesized
aagccauugaagaugcca

SEQ ID NO: 11507 - RNA, 18 nt, artificial
  Chemically synthesized
agacaucauccuggcauc

SEQ ID NO: 11508 - RNA, 18 nt, artificial
  Chemically synthesized
caaauuguccaugauaag

SEQ ID NO: 11509 - RNA, 18 nt, artificial
  Chemically synthesized
caacugaauuuuguuguc

SEQ ID NO: 11510 - RNA, 18 nt, artificial
  Chemically synthesized
aaugauaacauccacucu

SEQ ID NO: 11511 - RNA, 18 nt, artificial
  Chemically synthesized
cauacuuuaugcagccag

SEQ ID NO: 11512 - RNA, 18 nt, artificial
  Chemically synthesized
agcugaaauggaggcacc

SEQ ID NO: 11513 - RNA, 18 nt, artificial
  Chemically synthesized
ugcguggcucgcuaucac

SEQ ID NO: 11514 - RNA, 18 nt, artificial
  Chemically synthesized
uuaugugauugagacugu

SEQ ID NO: 11515 - RNA, 18 nt, artificial
  Chemically synthesized
aagaaaacgccugcagac

SEQ ID NO: 11516 - RNA, 18 nt, artificial
  Chemically synthesized
uggcaucauccucacugc

SEQ ID NO: 11517 - RNA, 18 nt, artificial
  Chemically synthesized
ucucccuaaagagauuca

SEQ ID NO: 11518 - RNA, 18 nt, artificial
  Chemically synthesized
acacaucuacuuucacua

SEQ ID NO: 11519 - RNA, 18 nt, artificial
  Chemically synthesized
gguccaggaaggucaagu

SEQ ID NO: 11520 - RNA, 18 nt, artificial
  Chemically synthesized
ccaggucugagcaaucuc

SEQ ID NO: 11521 - RNA, 18 nt, artificial
  Chemically synthesized
auuucucccuuccuccuu

SEQ ID NO: 11522 - RNA, 18 nt, artificial
  Chemically synthesized
uggacuuuuguuucucua

SEQ ID NO: 11523 - RNA, 18 nt, artificial
  Chemically synthesized
gggaaguucucuagagau

SEQ ID NO: 11524 - RNA, 18 nt, artificial
  Chemically synthesized
gaaccuggagggaguuca

SEQ ID NO: 11525 - RNA, 18 nt, artificial
  Chemically synthesized
acaucgagugacaaagug

SEQ ID NO: 11526 - RNA, 18 nt, artificial
  Chemically synthesized
cugcucaaaccaaacaca

SEQ ID NO: 11527 - RNA, 18 nt, artificial
  Chemically synthesized
agggacaggucuaaagag

SEQ ID NO: 11528 - RNA, 18 nt, artificial
  Chemically synthesized
ugaucaugcggacacaca

SEQ ID NO: 11529 - RNA, 18 nt, artificial
  Chemically synthesized
aauuagccacuagacuuu

SEQ ID NO: 11530 - RNA, 18 nt, artificial
  Chemically synthesized
ugccucugguccuugauc

SEQ ID NO: 11531 - RNA, 18 nt, artificial
  Chemically synthesized
auuccauucguucaacuu

SEQ ID NO: 11532 - RNA, 18 nt, artificial
  Chemically synthesized
cuggaaauccagauguuc

SEQ ID NO: 11533 - RNA, 18 nt, artificial
  Chemically synthesized
caaugucucuuucuguuu

SEQ ID NO: 11534 - RNA, 18 nt, artificial
  Chemically synthesized
ugugagcagcaguggccc

SEQ ID NO: 11535 - RNA, 18 nt, artificial
  Chemically synthesized
gucugaccgagcaguuuc

SEQ ID NO: 11536 - RNA, 18 nt, artificial
  Chemically synthesized
uaagauugugagccacau

SEQ ID NO: 11537 - RNA, 18 nt, artificial
  Chemically synthesized
cacaagaguagagaacuc

SEQ ID NO: 11538 - RNA, 18 nt, artificial
  Chemically synthesized
gagacagacuuaaaaugg

SEQ ID NO: 11539 - RNA, 18 nt, artificial
  Chemically synthesized
cucuguaaggagacagac

SEQ ID NO: 11540 - RNA, 18 nt, artificial
  Chemically synthesized
aauaccuucacacguagu

SEQ ID NO: 11541 - RNA, 18 nt, artificial
  Chemically synthesized
aagcauucccaccuuugu

SEQ ID NO: 11542 - RNA, 18 nt, artificial
  Chemically synthesized
cuuuuccauacuuccuug

SEQ ID NO: 11543 - RNA, 18 nt, artificial
  Chemically synthesized
auaaaguucauaggguuc

SEQ ID NO: 11544 - RNA, 18 nt, artificial
  Chemically synthesized
cuaaagagauucagaggu

SEQ ID NO: 11545 - RNA, 18 nt, artificial
  Chemically synthesized
ggagaggaaguuagaaga

SEQ ID NO: 11546 - RNA, 18 nt, artificial
  Chemically synthesized
agccauuucuacugagau

SEQ ID NO: 11547 - RNA, 18 nt, artificial
  Chemically synthesized
augguugugagcaugugu

SEQ ID NO: 11548 - RNA, 18 nt, artificial
  Chemically synthesized
ucaaacagccauagacau

SEQ ID NO: 11549 - RNA, 18 nt, artificial
  Chemically synthesized
aguuucucagcucuguga

SEQ ID NO: 11550 - RNA, 18 nt, artificial
  Chemically synthesized
aaggcgguacagcuccac

SEQ ID NO: 11551 - RNA, 18 nt, artificial
  Chemically synthesized
cagcagggcuuuucugag

SEQ ID NO: 11552 - RNA, 18 nt, artificial
  Chemically synthesized
aucuucaauugucuggau

SEQ ID NO: 11553 - RNA, 18 nt, artificial
  Chemically synthesized
aguuguuguggcucauau

SEQ ID NO: 11554 - RNA, 18 nt, artificial
  Chemically synthesized
gagcugaaauggaggcac

SEQ ID NO: 11555 - RNA, 18 nt, artificial
  Chemically synthesized
ccugcucaaaccaaacac

SEQ ID NO: 11556 - RNA, 18 nt, artificial
  Chemically synthesized
uggaugaagugcugggac

SEQ ID NO: 11557 - RNA, 18 nt, artificial
  Chemically synthesized
cgggaauaaagucucugu

SEQ ID NO: 11558 - RNA, 18 nt, artificial
  Chemically synthesized
acgcaggagaggaaggcc

SEQ ID NO: 11559 - RNA, 18 nt, artificial
  Chemically synthesized
guuguucuaagcccaaga

SEQ ID NO: 11560 - RNA, 18 nt, artificial
  Chemically synthesized
uuggagacaacugcucca

SEQ ID NO: 11561 - RNA, 18 nt, artificial
  Chemically synthesized
cuuucaugacagucauua

SEQ ID NO: 11562 - RNA, 18 nt, artificial
  Chemically synthesized
cagcuucuguaaacuuga

SEQ ID NO: 11563 - RNA, 18 nt, artificial
  Chemically synthesized
auuuauucccucugcacu

SEQ ID NO: 11564 - RNA, 18 nt, artificial
  Chemically synthesized
ccagcaagaagcaucagg

SEQ ID NO: 11565 - RNA, 18 nt, artificial
  Chemically synthesized
acuucuaaaccagccaga

SEQ ID NO: 11566 - RNA, 18 nt, artificial
  Chemically synthesized
ugugucucccuaaagaga

SEQ ID NO: 11567 - RNA, 18 nt, artificial
  Chemically synthesized
augaagugcugggacacc

SEQ ID NO: 11568 - RNA, 18 nt, artificial
  Chemically synthesized
agcauguguuaaucaggu

SEQ ID NO: 11569 - RNA, 18 nt, artificial
  Chemically synthesized
uuccagacacauuguuuu

SEQ ID NO: 11570 - RNA, 18 nt, artificial
  Chemically synthesized
ccuucugcaggacaauga

SEQ ID NO: 11571 - RNA, 18 nt, artificial
  Chemically synthesized
acugagagagguccagga

SEQ ID NO: 11572 - RNA, 18 nt, artificial
  Chemically synthesized
uguaaacuugauagucca

SEQ ID NO: 11573 - RNA, 18 nt, artificial
  Chemically synthesized
gucuuuuacccuuucaau

SEQ ID NO: 11574 - RNA, 18 nt, artificial
  Chemically synthesized
ugauuguccuuuucuuga

SEQ ID NO: 11575 - RNA, 18 nt, artificial
  Chemically synthesized
ccaccuggaagacucugu

SEQ ID NO: 11576 - RNA, 18 nt, artificial
  Chemically synthesized
gucucacgcaggagagga

SEQ ID NO: 11577 - RNA, 18 nt, artificial
  Chemically synthesized
augauuuaccauccagca

SEQ ID NO: 11578 - RNA, 18 nt, artificial
  Chemically synthesized
acuggacaagccauugaa

SEQ ID NO: 11579 - RNA, 18 nt, artificial
  Chemically synthesized
acaaugaagaugauacca

SEQ ID NO: 11580 - RNA, 18 nt, artificial
  Chemically synthesized
agugauaggaauacugaa

SEQ ID NO: 11581 - RNA, 18 nt, artificial
  Chemically synthesized
guagaucaacuucugaaa

SEQ ID NO: 11582 - RNA, 18 nt, artificial
  Chemically synthesized
ugcaacucauuucaugag

SEQ ID NO: 11583 - RNA, 18 nt, artificial
  Chemically synthesized
aagucauucugaguaaga

SEQ ID NO: 11584 - RNA, 18 nt, artificial
  Chemically synthesized
cugcuuaucugaaggugu

SEQ ID NO: 11585 - RNA, 18 nt, artificial
  Chemically synthesized
aguuucugaggcacuggu

SEQ ID NO: 11586 - RNA, 18 nt, artificial
  Chemically synthesized
agucuuuuacccuuucaa

SEQ ID NO: 11587 - RNA, 18 nt, artificial
  Chemically synthesized
cugcuacaacagauacua

SEQ ID NO: 11588 - RNA, 18 nt, artificial
  Chemically synthesized
caguuucugaggcacugg

SEQ ID NO: 11589 - RNA, 18 nt, artificial
  Chemically synthesized
cuggaaagguccaagugc

SEQ ID NO: 11590 - RNA, 18 nt, artificial
  Chemically synthesized
aggaagcggaaauuuucu

SEQ ID NO: 11591 - RNA, 18 nt, artificial
  Chemically synthesized
aucuuguugcuggaaagg

SEQ ID NO: 11592 - RNA, 18 nt, artificial
  Chemically synthesized
agaaaugccucaggaggu

SEQ ID NO: 11593 - RNA, 18 nt, artificial
  Chemically synthesized
acuggaagcuccuugaga

SEQ ID NO: 11594 - RNA, 18 nt, artificial
  Chemically synthesized
ggagguuuuuauuuuucc

SEQ ID NO: 11595 - RNA, 18 nt, artificial
  Chemically synthesized
aagguguugcacauucca

SEQ ID NO: 11596 - RNA, 18 nt, artificial
  Chemically synthesized
aaagguccaagugcucua

SEQ ID NO: 11597 - RNA, 18 nt, artificial
  Chemically synthesized
caagaguagagaacucau

SEQ ID NO: 11598 - RNA, 18 nt, artificial
  Chemically synthesized
caaagugacagaguguac

SEQ ID NO: 11599 - RNA, 18 nt, artificial
  Chemically synthesized
ugcauaucuagugcacca

SEQ ID NO: 11600 - RNA, 18 nt, artificial
  Chemically synthesized
ugaagugcugggacacca

SEQ ID NO: 11601 - RNA, 18 nt, artificial
  Chemically synthesized
uuucugaggaggcuggau

SEQ ID NO: 11602 - RNA, 18 nt, artificial
  Chemically synthesized
auagaacaugcucgagaa

SEQ ID NO: 11603 - RNA, 18 nt, artificial
  Chemically synthesized
aaauuggaaugcuggaaa

SEQ ID NO: 11604 - RNA, 18 nt, artificial
  Chemically synthesized
ucaagaaccuggagggag

SEQ ID NO: 11605 - RNA, 18 nt, artificial
  Chemically synthesized
aacucaaggcuugguaga

SEQ ID NO: 11606 - RNA, 18 nt, artificial
  Chemically synthesized
aucaagaaaaggugaccu

SEQ ID NO: 11607 - RNA, 18 nt, artificial
  Chemically synthesized
gucaaguuucucagcucu

SEQ ID NO: 11608 - RNA, 18 nt, artificial
  Chemically synthesized
aaagacucaggaaaagaa

SEQ ID NO: 11609 - RNA, 18 nt, artificial
  Chemically synthesized
cucauuucaugaggucac

SEQ ID NO: 11610 - RNA, 18 nt, artificial
  Chemically synthesized
uuucacaccuccacgcag

SEQ ID NO: 11611 - RNA, 18 nt, artificial
  Chemically synthesized
gccacuagacuuuaaccu

SEQ ID NO: 11612 - RNA, 18 nt, artificial
  Chemically synthesized
ucauuucaugaggucacc

SEQ ID NO: 11613 - RNA, 18 nt, artificial
  Chemically synthesized
ugugaaugcguggcucgc

SEQ ID NO: 11614 - RNA, 18 nt, artificial
  Chemically synthesized
gaagucauuaugugauug

SEQ ID NO: 11615 - RNA, 18 nt, artificial
  Chemically synthesized
caaacacacucugaaaca

SEQ ID NO: 11616 - RNA, 18 nt, artificial
  Chemically synthesized
gaucaacuucugaaaaag

SEQ ID NO: 11617 - RNA, 18 nt, artificial
  Chemically synthesized
cagcggcucuggaugaag

SEQ ID NO: 11618 - RNA, 18 nt, artificial
  Chemically synthesized
aacgauggacuucuaaac

SEQ ID NO: 11619 - RNA, 18 nt, artificial
  Chemically synthesized
ugugaagauaucuggaag

SEQ ID NO: 11620 - RNA, 18 nt, artificial
  Chemically synthesized
cagagcugaaauggaggc

SEQ ID NO: 11621 - RNA, 18 nt, artificial
  Chemically synthesized
accgacacaccaaugaug

SEQ ID NO: 11622 - RNA, 18 nt, artificial
  Chemically synthesized
cugcagucaucaaguaga

SEQ ID NO: 11623 - RNA, 18 nt, artificial
  Chemically synthesized
ccgagcaguuucugaggc

SEQ ID NO: 11624 - RNA, 18 nt, artificial
  Chemically synthesized
aacuucugcugcaacuca

SEQ ID NO: 11625 - RNA, 18 nt, artificial
  Chemically synthesized
uaucuagugcaccaugga

SEQ ID NO: 11626 - RNA, 18 nt, artificial
  Chemically synthesized
aucagagucccagccagg

SEQ ID NO: 11627 - RNA, 18 nt, artificial
  Chemically synthesized
gacaagccauugaagaug

SEQ ID NO: 11628 - RNA, 18 nt, artificial
  Chemically synthesized
gaagcuccuugagauuag

SEQ ID NO: 11629 - RNA, 18 nt, artificial
  Chemically synthesized
agcuccuugagauuagca

SEQ ID NO: 11630 - RNA, 18 nt, artificial
  Chemically synthesized
acuucugacuguggucau

SEQ ID NO: 11631 - RNA, 18 nt, artificial
  Chemically synthesized
auacuuuaggcugguugu

SEQ ID NO: 11632 - RNA, 18 nt, artificial
  Chemically synthesized
cagacuuaaaauggaagg

SEQ ID NO: 11633 - RNA, 18 nt, artificial
  Chemically synthesized
guaugcuaaucggaauuc

SEQ ID NO: 11634 - RNA, 18 nt, artificial
  Chemically synthesized
aaaaugcuguaguuccug

SEQ ID NO: 11635 - RNA, 18 nt, artificial
  Chemically synthesized
cacacugaggaccgacac

SEQ ID NO: 11636 - RNA, 18 nt, artificial
  Chemically synthesized
gaccugcucaaaccaaac

SEQ ID NO: 11637 - RNA, 18 nt, artificial
  Chemically synthesized
auguggucaaggagcauu

SEQ ID NO: 11638 - RNA, 18 nt, artificial
  Chemically synthesized
cuuccuuccugccucuag

SEQ ID NO: 11639 - RNA, 18 nt, artificial
  Chemically synthesized
gagugaguuaaaugcugu

SEQ ID NO: 11640 - RNA, 18 nt, artificial
  Chemically synthesized
gcagggucuucuccaccu

SEQ ID NO: 11641 - RNA, 18 nt, artificial
  Chemically synthesized
aacugccaggucugagca

SEQ ID NO: 11642 - RNA, 18 nt, artificial
  Chemically synthesized
uauuagcuuauaggcaag

SEQ ID NO: 11643 - RNA, 18 nt, artificial
  Chemically synthesized
gucauucugaguaagauu

SEQ ID NO: 11644 - RNA, 18 nt, artificial
  Chemically synthesized
ucugacaggugauauuca

SEQ ID NO: 11645 - RNA, 18 nt, artificial
  Chemically synthesized
uuaggaauuagccacuag

SEQ ID NO: 11646 - RNA, 18 nt, artificial
  Chemically synthesized
gcuuaggcucugauaugc

SEQ ID NO: 11647 - RNA, 18 nt, artificial
  Chemically synthesized
uaucaccgucugaccgag

SEQ ID NO: 11648 - RNA, 18 nt, artificial
  Chemically synthesized
acuacuguacaagcacaa

SEQ ID NO: 11649 - RNA, 18 nt, artificial
  Chemically synthesized
cuaaagaaacagcaagag

SEQ ID NO: 11650 - RNA, 18 nt, artificial
  Chemically synthesized
aaaugcuguaguuccugu

SEQ ID NO: 11651 - RNA, 18 nt, artificial
  Chemically synthesized
gaugccauugaaagcaac

SEQ ID NO: 11652 - RNA, 18 nt, artificial
  Chemically synthesized
ugccaggucugagcaauc

SEQ ID NO: 11653 - RNA, 18 nt, artificial
  Chemically synthesized
ucuggugugaguaugaga

SEQ ID NO: 11654 - RNA, 18 nt, artificial
  Chemically synthesized
agugaacacccaguucag

SEQ ID NO: 11655 - RNA, 18 nt, artificial
  Chemically synthesized
aagucuuuuacccuuuca

SEQ ID NO: 11656 - RNA, 18 nt, artificial
  Chemically synthesized
ugagagagguccaggaag

SEQ ID NO: 11657 - RNA, 18 nt, artificial
  Chemically synthesized
acugcucagaaacugcca

SEQ ID NO: 11658 - RNA, 18 nt, artificial
  Chemically synthesized
uauacucccugccuugaa

SEQ ID NO: 11659 - RNA, 18 nt, artificial
  Chemically synthesized
uccacgcagggcucccag

SEQ ID NO: 11660 - RNA, 18 nt, artificial
  Chemically synthesized
aucauccucacugcuucu

SEQ ID NO: 11661 - RNA, 18 nt, artificial
  Chemically synthesized
guagagaacucaucucaa

SEQ ID NO: 11662 - RNA, 18 nt, artificial
  Chemically synthesized
ccugguuggauaaaguuc

SEQ ID NO: 11663 - RNA, 18 nt, artificial
  Chemically synthesized
uuuuccauacuuccuuga

SEQ ID NO: 11664 - RNA, 18 nt, artificial
  Chemically synthesized
uaauaucaucgagguagu

SEQ ID NO: 11665 - RNA, 18 nt, artificial
  Chemically synthesized
caccagcggcucuggaug

SEQ ID NO: 11666 - RNA, 18 nt, artificial
  Chemically synthesized
cucaguaacaaacacuuc

SEQ ID NO: 11667 - RNA, 18 nt, artificial
  Chemically synthesized
uguggucauauuuccagu

SEQ ID NO: 11668 - RNA, 18 nt, artificial
  Chemically synthesized
gugcugggacaccacaac

SEQ ID NO: 11669 - RNA, 18 nt, artificial
  Chemically synthesized
cucuaccauacuuuaugc

SEQ ID NO: 11670 - RNA, 18 nt, artificial
  Chemically synthesized
gauguucuaguuguucua

SEQ ID NO: 11671 - RNA, 18 nt, artificial
  Chemically synthesized
cuuccugccucuagccca

SEQ ID NO: 11672 - RNA, 18 nt, artificial
  Chemically synthesized
cccaucuucaauugucug

SEQ ID NO: 11673 - RNA, 18 nt, artificial
  Chemically synthesized
cauaucuagugcaccaug

SEQ ID NO: 11674 - RNA, 18 nt, artificial
  Chemically synthesized
aagugaaagcggcaaccu

SEQ ID NO: 11675 - RNA, 18 nt, artificial
  Chemically synthesized
cuacuguacaagcacaag

SEQ ID NO: 11676 - RNA, 18 nt, artificial
  Chemically synthesized
ugaggcacuggugucuuc

SEQ ID NO: 11677 - RNA, 18 nt, artificial
  Chemically synthesized
agauagauguugcuuccu

SEQ ID NO: 11678 - RNA, 18 nt, artificial
  Chemically synthesized
ggcuugguagaucaacuu

SEQ ID NO: 11679 - RNA, 18 nt, artificial
  Chemically synthesized
gagcagauuugucaaacu

SEQ ID NO: 11680 - RNA, 18 nt, artificial
  Chemically synthesized
ugaaagcggcaaccuuag

SEQ ID NO: 11681 - RNA, 18 nt, artificial
  Chemically synthesized
cuggaagcuccuugagau

SEQ ID NO: 11682 - RNA, 18 nt, artificial
  Chemically synthesized
augauguuggcagcaaug

SEQ ID NO: 11683 - RNA, 18 nt, artificial
  Chemically synthesized
uccaaugaaaagaaguug

SEQ ID NO: 11684 - RNA, 18 nt, artificial
  Chemically synthesized
gucgucuccagaagaugu

SEQ ID NO: 11685 - RNA, 18 nt, artificial
  Chemically synthesized
ggauaugugcacaaaugc

SEQ ID NO: 11686 - RNA, 18 nt, artificial
  Chemically synthesized
acagauacuacaagcaca

SEQ ID NO: 11687 - RNA, 18 nt, artificial
  Chemically synthesized
ucccuaaagagauucaga

SEQ ID NO: 11688 - RNA, 18 nt, artificial
  Chemically synthesized
cauugcccaacaggaaac

SEQ ID NO: 11689 - RNA, 18 nt, artificial
  Chemically synthesized
uccaccuucugcaggaca

SEQ ID NO: 11690 - RNA, 18 nt, artificial
  Chemically synthesized
uggagggaguucagacac

SEQ ID NO: 11691 - RNA, 18 nt, artificial
  Chemically synthesized
acauuccauucguucaac

SEQ ID NO: 11692 - RNA, 18 nt, artificial
  Chemically synthesized
ccuugaauacaaguuuuc

SEQ ID NO: 11693 - RNA, 18 nt, artificial
  Chemically synthesized
uucauggaugauguuggc

SEQ ID NO: 11694 - RNA, 18 nt, artificial
  Chemically synthesized
uucuggauuccaugauuu

SEQ ID NO: 11695 - RNA, 18 nt, artificial
  Chemically synthesized
caucgagugacaaaguga

SEQ ID NO: 11696 - RNA, 18 nt, artificial
  Chemically synthesized
ucacccuagaccugcuca

SEQ ID NO: 11697 - RNA, 18 nt, artificial
  Chemically synthesized
caccagcuucuguaaacu

SEQ ID NO: 11698 - RNA, 18 nt, artificial
  Chemically synthesized
ucugugaagauaucugga

SEQ ID NO: 11699 - RNA, 18 nt, artificial
  Chemically synthesized
cuguuccuucuggauucc

SEQ ID NO: 11700 - RNA, 18 nt, artificial
  Chemically synthesized
gcuggaugaacauucuuu

SEQ ID NO: 11701 - RNA, 18 nt, artificial
  Chemically synthesized
aaaggugaccuccugagg

SEQ ID NO: 11702 - RNA, 18 nt, artificial
  Chemically synthesized
ucaagaaaaggugaccuc

SEQ ID NO: 11703 - RNA, 18 nt, artificial
  Chemically synthesized
gccauuucuacugagauc

SEQ ID NO: 11704 - RNA, 18 nt, artificial
  Chemically synthesized
ugccucuagcccaaauug

SEQ ID NO: 11705 - RNA, 18 nt, artificial
  Chemically synthesized
aaugcccaccuggaagac

SEQ ID NO: 11706 - RNA, 18 nt, artificial
  Chemically synthesized
ugacagaguguacuuuuc

SEQ ID NO: 11707 - RNA, 18 nt, artificial
  Chemically synthesized
cacuuucaaauacacaca

SEQ ID NO: 11708 - RNA, 18 nt, artificial
  Chemically synthesized
agagcugccucugguccu

SEQ ID NO: 11709 - RNA, 18 nt, artificial
  Chemically synthesized
cugguugucccaaaauca

SEQ ID NO: 11710 - RNA, 18 nt, artificial
  Chemically synthesized
cucuggaugaagugcugg

SEQ ID NO: 11711 - RNA, 18 nt, artificial
  Chemically synthesized
auggaugauguuggcagc

SEQ ID NO: 11712 - RNA, 18 nt, artificial
  Chemically synthesized
ucugaagguguugcacau

SEQ ID NO: 11713 - RNA, 18 nt, artificial
  Chemically synthesized
agcaaagucauucugagu

SEQ ID NO: 11714 - RNA, 18 nt, artificial
  Chemically synthesized
cuugaugagguaagaguu

SEQ ID NO: 11715 - RNA, 18 nt, artificial
  Chemically synthesized
cgauggacuucuaaacca

SEQ ID NO: 11716 - RNA, 18 nt, artificial
  Chemically synthesized
agguaaaugagguuucug

SEQ ID NO: 11717 - RNA, 18 nt, artificial
  Chemically synthesized
acuucgagacuggacaag

SEQ ID NO: 11718 - RNA, 18 nt, artificial
  Chemically synthesized
caucauccuggcaucauc

SEQ ID NO: 11719 - RNA, 18 nt, artificial
  Chemically synthesized
ugcacaaaugcacacauc

SEQ ID NO: 11720 - RNA, 18 nt, artificial
  Chemically synthesized
acagacuuaaaauggaag

SEQ ID NO: 11721 - RNA, 18 nt, artificial
  Chemically synthesized
auguucuguuucugagga

SEQ ID NO: 11722 - RNA, 18 nt, artificial
  Chemically synthesized
cagaguguacuuuuccau

SEQ ID NO: 11723 - RNA, 18 nt, artificial
  Chemically synthesized
ucuucccaaaaugugguc

SEQ ID NO: 11724 - RNA, 18 nt, artificial
  Chemically synthesized
uucuggacuuuuguuucu

SEQ ID NO: 11725 - RNA, 18 nt, artificial
  Chemically synthesized
gaaacacacccagggaug

SEQ ID NO: 11726 - RNA, 18 nt, artificial
  Chemically synthesized
aaguuuugagauguccaa

SEQ ID NO: 11727 - RNA, 18 nt, artificial
  Chemically synthesized
ucccacuccagguaagug

SEQ ID NO: 11728 - RNA, 18 nt, artificial
  Chemically synthesized
ugauuuaccauccagcag

SEQ ID NO: 11729 - RNA, 18 nt, artificial
  Chemically synthesized
agaaccaaacgauggacu

SEQ ID NO: 11730 - RNA, 18 nt, artificial
  Chemically synthesized
gaaaaagugaacacccag

SEQ ID NO: 11731 - RNA, 18 nt, artificial
  Chemically synthesized
ugagucgucuccagaaga

SEQ ID NO: 11732 - RNA, 18 nt, artificial
  Chemically synthesized
gauaagauugugagccac

SEQ ID NO: 11733 - RNA, 18 nt, artificial
  Chemically synthesized
caaaggcaucauagaugu

SEQ ID NO: 11734 - RNA, 18 nt, artificial
  Chemically synthesized
aauugcauccuguaccca

SEQ ID NO: 11735 - RNA, 18 nt, artificial
  Chemically synthesized
uacaagcacaagaguaga

SEQ ID NO: 11736 - RNA, 18 nt, artificial
  Chemically synthesized
uccagguaaguguuccug

SEQ ID NO: 11737 - RNA, 18 nt, artificial
  Chemically synthesized
ucugagcaaucucauauu

SEQ ID NO: 11738 - RNA, 18 nt, artificial
  Chemically synthesized
aguuuugagauguccaau

SEQ ID NO: 11739 - RNA, 18 nt, artificial
  Chemically synthesized
aagugaaaguaagccuuu

SEQ ID NO: 11740 - RNA, 18 nt, artificial
  Chemically synthesized
aguaugcuaaucggaauu

SEQ ID NO: 11741 - RNA, 18 nt, artificial
  Chemically synthesized
gucaauaauaucaucgag

SEQ ID NO: 11742 - RNA, 18 nt, artificial
  Chemically synthesized
uccucauccuggcuugag

SEQ ID NO: 11743 - RNA, 18 nt, artificial
  Chemically synthesized
guuaaaugcuguuggaga

SEQ ID NO: 11744 - RNA, 18 nt, artificial
  Chemically synthesized
aguguuccugcugagaag

SEQ ID NO: 11745 - RNA, 18 nt, artificial
  Chemically synthesized
cccuuagcauaaggccug

SEQ ID NO: 11746 - RNA, 18 nt, artificial
  Chemically synthesized
aaugcacacaucuacuuu

SEQ ID NO: 11747 - RNA, 18 nt, artificial
  Chemically synthesized
cacgcagggcucccagcu

SEQ ID NO: 11748 - RNA, 18 nt, artificial
  Chemically synthesized
aucaugcggacacacaca

SEQ ID NO: 11749 - RNA, 18 nt, artificial
  Chemically synthesized
ugggaucagagucccagc

SEQ ID NO: 11750 - RNA, 18 nt, artificial
  Chemically synthesized
cgacugcagucaucaagu

SEQ ID NO: 11751 - RNA, 18 nt, artificial
  Chemically synthesized
ccaccagcuucuguaaac

SEQ ID NO: 11752 - RNA, 18 nt, artificial
  Chemically synthesized
cgccugcagaccaguggc

SEQ ID NO: 11753 - RNA, 18 nt, artificial
  Chemically synthesized
auccugauuguccuuuuc

SEQ ID NO: 11754 - RNA, 18 nt, artificial
  Chemically synthesized
ucagguuuccuuaggaau

SEQ ID NO: 11755 - RNA, 18 nt, artificial
  Chemically synthesized
caacucccuauuuccuca

SEQ ID NO: 11756 - RNA, 18 nt, artificial
  Chemically synthesized
acuguccucccacuccag

SEQ ID NO: 11757 - RNA, 18 nt, artificial
  Chemically synthesized
aauacacacagcccugau

SEQ ID NO: 11758 - RNA, 18 nt, artificial
  Chemically synthesized
cuucugcugcaacucauu

SEQ ID NO: 11759 - RNA, 18 nt, artificial
  Chemically synthesized
agagauucagagguccau

SEQ ID NO: 11760 - RNA, 18 nt, artificial
  Chemically synthesized
ucuguagugaaggcagag

SEQ ID NO: 11761 - RNA, 18 nt, artificial
  Chemically synthesized
acuuccaccaagagcugc

SEQ ID NO: 11762 - RNA, 18 nt, artificial
  Chemically synthesized
gcuugguagaucaacuuc

SEQ ID NO: 11763 - RNA, 18 nt, artificial
  Chemically synthesized
gaaucaagaaaaggugac

SEQ ID NO: 11764 - RNA, 18 nt, artificial
  Chemically synthesized
uucugcugcaacucauuu

SEQ ID NO: 11765 - RNA, 18 nt, artificial
  Chemically synthesized
agguguugcacauuccau

SEQ ID NO: 11766 - RNA, 18 nt, artificial
  Chemically synthesized
cucuagauuggucagauu

SEQ ID NO: 11767 - RNA, 18 nt, artificial
  Chemically synthesized
ccugagcagggucuucuc

SEQ ID NO: 11768 - RNA, 18 nt, artificial
  Chemically synthesized
accuccugaggucauccc

SEQ ID NO: 11769 - RNA, 18 nt, artificial
  Chemically synthesized
gagagguccaggaagguc

SEQ ID NO: 11770 - RNA, 18 nt, artificial
  Chemically synthesized
cuccugaggucaucccac

SEQ ID NO: 11771 - RNA, 18 nt, artificial
  Chemically synthesized
aucuacuuucacuaguac

SEQ ID NO: 11772 - RNA, 18 nt, artificial
  Chemically synthesized
uaaauacuuuaggcuggu

SEQ ID NO: 11773 - RNA, 18 nt, artificial
  Chemically synthesized
uguuggacccagcugggc

SEQ ID NO: 11774 - RNA, 18 nt, artificial
  Chemically synthesized
ucgagugacaaagugaca

SEQ ID NO: 11775 - RNA, 18 nt, artificial
  Chemically synthesized
uguccucccacuccaggu

SEQ ID NO: 11776 - RNA, 18 nt, artificial
  Chemically synthesized
uaguuccuguuuuuugga

SEQ ID NO: 11777 - RNA, 18 nt, artificial
  Chemically synthesized
gaagaagaaaacgccugc

SEQ ID NO: 11778 - RNA, 18 nt, artificial
  Chemically synthesized
uuagcuuauaggcaagac

SEQ ID NO: 11779 - RNA, 18 nt, artificial
  Chemically synthesized
caagaaaugccucaggag

SEQ ID NO: 11780 - RNA, 18 nt, artificial
  Chemically synthesized
caccuuuguuggaaguga

SEQ ID NO: 11781 - RNA, 18 nt, artificial
  Chemically synthesized
cacacucugaaacacuca

SEQ ID NO: 11782 - RNA, 18 nt, artificial
  Chemically synthesized
uggauauuugaagcacgu

SEQ ID NO: 11783 - RNA, 18 nt, artificial
  Chemically synthesized
cacacaucuacuuucacu

SEQ ID NO: 11784 - RNA, 18 nt, artificial
  Chemically synthesized
ugguccuugauccauugc

SEQ ID NO: 11785 - RNA, 18 nt, artificial
  Chemically synthesized
aaguacaagcaaagucau

SEQ ID NO: 11786 - RNA, 18 nt, artificial
  Chemically synthesized
agcggcucuggaugaagu

SEQ ID NO: 11787 - RNA, 18 nt, artificial
  Chemically synthesized
uggaaggaaguuuuccug

SEQ ID NO: 11788 - RNA, 18 nt, artificial
  Chemically synthesized
acguaguucuccuggcag

SEQ ID NO: 11789 - RNA, 18 nt, artificial
  Chemically synthesized
ucacgcaggagaggaagg

SEQ ID NO: 11790 - RNA, 18 nt, artificial
  Chemically synthesized
acuuuggaaugacaucga

SEQ ID NO: 11791 - RNA, 18 nt, artificial
  Chemically synthesized
cuuuuauggaaaccuuca

SEQ ID NO: 11792 - RNA, 18 nt, artificial
  Chemically synthesized
gguaagaguugaaaugac

SEQ ID NO: 11793 - RNA, 18 nt, artificial
  Chemically synthesized
agguccaucaaacaucac

SEQ ID NO: 11794 - RNA, 18 nt, artificial
  Chemically synthesized
cugugaaugcguggcucg

SEQ ID NO: 11795 - RNA, 18 nt, artificial
  Chemically synthesized
gaguguacuuuuccauac

SEQ ID NO: 11796 - RNA, 18 nt, artificial
  Chemically synthesized
cugcaacucauuucauga

SEQ ID NO: 11797 - RNA, 18 nt, artificial
  Chemically synthesized
gugucuucucuuccucga

SEQ ID NO: 11798 - RNA, 18 nt, artificial
  Chemically synthesized
aggaugguugugagcaug

SEQ ID NO: 11799 - RNA, 18 nt, artificial
  Chemically synthesized
gcagggcuuuucugaguc

SEQ ID NO: 11800 - RNA, 18 nt, artificial
  Chemically synthesized
agcauucccaccuuuguu

SEQ ID NO: 11801 - RNA, 18 nt, artificial
  Chemically synthesized
ucccaaaaucacuuugag

SEQ ID NO: 11802 - RNA, 18 nt, artificial
  Chemically synthesized
gcggcucuggaugaagug

SEQ ID NO: 11803 - RNA, 18 nt, artificial
  Chemically synthesized
cugcugagaaggcgguac

SEQ ID NO: 11804 - RNA, 18 nt, artificial
  Chemically synthesized
ugcugagaaggcgguaca

SEQ ID NO: 11805 - RNA, 18 nt, artificial
  Chemically synthesized
gucauuaugugauugaga

SEQ ID NO: 11806 - RNA, 18 nt, artificial
  Chemically synthesized
auuuucaagacuucgaga

SEQ ID NO: 11807 - RNA, 18 nt, artificial
  Chemically synthesized
aggagaggaaggccaugg

SEQ ID NO: 11808 - RNA, 18 nt, artificial
  Chemically synthesized
acgacugcagucaucaag

SEQ ID NO: 11809 - RNA, 18 nt, artificial
  Chemically synthesized
gccuuuugagagauuuga

SEQ ID NO: 11810 - RNA, 18 nt, artificial
  Chemically synthesized
augaagaugauaccagca

SEQ ID NO: 11811 - RNA, 18 nt, artificial
  Chemically synthesized
cggcucuggaugaagugc

SEQ ID NO: 11812 - RNA, 18 nt, artificial
  Chemically synthesized
aacaugcucgagaaugac

SEQ ID NO: 11813 - RNA, 18 nt, artificial
  Chemically synthesized
cccauuaauuccagacac

SEQ ID NO: 11814 - RNA, 18 nt, artificial
  Chemically synthesized
gauuugaguuucaaugug

SEQ ID NO: 11815 - RNA, 18 nt, artificial
  Chemically synthesized
acacacacacuuucaaau

SEQ ID NO: 11816 - RNA, 18 nt, artificial
  Chemically synthesized
aggcaucauagauguuuu

SEQ ID NO: 11817 - RNA, 18 nt, artificial
  Chemically synthesized
uucaaaagacucaggaaa

SEQ ID NO: 11818 - RNA, 18 nt, artificial
  Chemically synthesized
uuuuccaaguuuccuuca

SEQ ID NO: 11819 - RNA, 18 nt, artificial
  Chemically synthesized
caccuggaagacucugua

SEQ ID NO: 11820 - RNA, 18 nt, artificial
  Chemically synthesized
uuuuccuggaaagaauug

SEQ ID NO: 11821 - RNA, 18 nt, artificial
  Chemically synthesized
cugggaucagagucccag

SEQ ID NO: 11822 - RNA, 18 nt, artificial
  Chemically synthesized
accaaacgauggacuucu

SEQ ID NO: 11823 - RNA, 18 nt, artificial
  Chemically synthesized
aguuuuccuggaaagaau

SEQ ID NO: 11824 - RNA, 18 nt, artificial
  Chemically synthesized
agguagagagguggcuua

SEQ ID NO: 11825 - RNA, 18 nt, artificial
  Chemically synthesized
cacaggcccucuagagca

SEQ ID NO: 11826 - RNA, 18 nt, artificial
  Chemically synthesized
gucuagcauuuauucccu

SEQ ID NO: 11827 - RNA, 18 nt, artificial
  Chemically synthesized
ccuucauggaugauguug

SEQ ID NO: 11828 - RNA, 18 nt, artificial
  Chemically synthesized
cagccauagacauccauu

SEQ ID NO: 11829 - RNA, 18 nt, artificial
  Chemically synthesized
acaucacuuguucugaaa

SEQ ID NO: 11830 - RNA, 18 nt, artificial
  Chemically synthesized
agauaucuggaaggaagu

SEQ ID NO: 11831 - RNA, 18 nt, artificial
  Chemically synthesized
gguaauuugaaagauugg

SEQ ID NO: 11832 - RNA, 18 nt, artificial
  Chemically synthesized
aagguaaaugagguuucu

SEQ ID NO: 11833 - RNA, 18 nt, artificial
  Chemically synthesized
caagccauugaagaugcc

SEQ ID NO: 11834 - RNA, 18 nt, artificial
  Chemically synthesized
uacuuuaugcagccagca

SEQ ID NO: 11835 - RNA, 18 nt, artificial
  Chemically synthesized
uaaagggugagaggaagu

SEQ ID NO: 11836 - RNA, 18 nt, artificial
  Chemically synthesized
cugcuccaguugacacug

SEQ ID NO: 11837 - RNA, 18 nt, artificial
  Chemically synthesized
cccugugaaugcguggcu

SEQ ID NO: 11838 - RNA, 18 nt, artificial
  Chemically synthesized
gcagagcugaaauggagg

SEQ ID NO: 11839 - RNA, 18 nt, artificial
  Chemically synthesized
agagcugaaauggaggca

SEQ ID NO: 11840 - RNA, 18 nt, artificial
  Chemically synthesized
uagacuuuaaccucugua

SEQ ID NO: 11841 - RNA, 18 nt, artificial
  Chemically synthesized
ccucuagagcagauuugu

SEQ ID NO: 11842 - RNA, 18 nt, artificial
  Chemically synthesized
uacaccagcggcucugga

SEQ ID NO: 11843 - RNA, 18 nt, artificial
  Chemically synthesized
uguuuucaccucuaccau

SEQ ID NO: 11844 - RNA, 18 nt, artificial
  Chemically synthesized
uugcacauuccauucguu

SEQ ID NO: 11845 - RNA, 18 nt, artificial
  Chemically synthesized
cacgucuuaaacaaccuu

SEQ ID NO: 11846 - RNA, 18 nt, artificial
  Chemically synthesized
caaguguuggacccagcu

SEQ ID NO: 11847 - RNA, 18 nt, artificial
  Chemically synthesized
agccagcaagaagcauca

SEQ ID NO: 11848 - RNA, 18 nt, artificial
  Chemically synthesized
ccuggagggaguucagac

SEQ ID NO: 11849 - RNA, 18 nt, artificial
  Chemically synthesized
uaugaucaugcggacaca

SEQ ID NO: 11850 - RNA, 18 nt, artificial
  Chemically synthesized
aacaggaaacagcaaugu

SEQ ID NO: 11851 - RNA, 18 nt, artificial
  Chemically synthesized
ggcgguacagcuccaccu

SEQ ID NO: 11852 - RNA, 18 nt, artificial
  Chemically synthesized
ugugggaaacuguccaaa

SEQ ID NO: 11853 - RNA, 18 nt, artificial
  Chemically synthesized
acaggagaggaaguuaga

SEQ ID NO: 11854 - RNA, 18 nt, artificial
  Chemically synthesized
aagcacaagaguagagaa

SEQ ID NO: 11855 - RNA, 18 nt, artificial
  Chemically synthesized
gguaaaugagguuucuga

SEQ ID NO: 11856 - RNA, 18 nt, artificial
  Chemically synthesized
gacuacuguacaagcaca

SEQ ID NO: 11857 - RNA, 18 nt, artificial
  Chemically synthesized
gcaagacguaaaaaaaug

SEQ ID NO: 11858 - RNA, 18 nt, artificial
  Chemically synthesized
cucuguauuuuagucuag

SEQ ID NO: 11859 - RNA, 18 nt, artificial
  Chemically synthesized
accaaugauggucuuauu

SEQ ID NO: 11860 - RNA, 18 nt, artificial
  Chemically synthesized
ccagccaucugugucucc

SEQ ID NO: 11861 - RNA, 18 nt, artificial
  Chemically synthesized
uagagcagauuugucaaa

SEQ ID NO: 11862 - RNA, 18 nt, artificial
  Chemically synthesized
uucuaagcccaagaaguu

SEQ ID NO: 11863 - RNA, 18 nt, artificial
  Chemically synthesized
uuccaccaagagcugccu

SEQ ID NO: 11864 - RNA, 18 nt, artificial
  Chemically synthesized
caacugcuccaguugaca

SEQ ID NO: 11865 - RNA, 18 nt, artificial
  Chemically synthesized
gaaagguccaagugcucu

SEQ ID NO: 11866 - RNA, 18 nt, artificial
  Chemically synthesized
aaccaaacacacucugaa

SEQ ID NO: 11867 - RNA, 18 nt, artificial
  Chemically synthesized
cucuucccaaaauguggu

SEQ ID NO: 11868 - RNA, 18 nt, artificial
  Chemically synthesized
ugcuuucaugacagucau

SEQ ID NO: 11869 - RNA, 18 nt, artificial
  Chemically synthesized
guuguuguggcucauauu

SEQ ID NO: 11870 - RNA, 18 nt, artificial
  Chemically synthesized
ccacuagacuuuaaccuc

SEQ ID NO: 11871 - RNA, 18 nt, artificial
  Chemically synthesized
cuguuuuuuggaagucau

SEQ ID NO: 11872 - RNA, 18 nt, artificial
  Chemically synthesized
cacuguccucccacucca

SEQ ID NO: 11873 - RNA, 18 nt, artificial
  Chemically synthesized
agcagauuugucaaacuu

SEQ ID NO: 11874 - RNA, 18 nt, artificial
  Chemically synthesized
uagggauacauagggaua

SEQ ID NO: 11875 - RNA, 18 nt, artificial
  Chemically synthesized
uguuccugcugagaaggc

SEQ ID NO: 11876 - RNA, 18 nt, artificial
  Chemically synthesized
gguccaagugcucuagau

SEQ ID NO: 11877 - RNA, 18 nt, artificial
  Chemically synthesized
augcucgagaaugaccag

SEQ ID NO: 11878 - RNA, 18 nt, artificial
  Chemically synthesized
acacagcccugauaggga

SEQ ID NO: 11879 - RNA, 18 nt, artificial
  Chemically synthesized
acuagacuuuaaccucug

SEQ ID NO: 11880 - RNA, 18 nt, artificial
  Chemically synthesized
aaaaggugaccuccugag

SEQ ID NO: 11881 - RNA, 18 nt, artificial
  Chemically synthesized
aaauugcacaggcccucu

SEQ ID NO: 11882 - RNA, 18 nt, artificial
  Chemically synthesized
ccucugcacuggaagcuc

SEQ ID NO: 11883 - RNA, 18 nt, artificial
  Chemically synthesized
guagucuaaguaugcuaa

SEQ ID NO: 11884 - RNA, 18 nt, artificial
  Chemically synthesized
gagguccaucaaacauca

SEQ ID NO: 11885 - RNA, 18 nt, artificial
  Chemically synthesized
cugcuucugugagcagca

SEQ ID NO: 11886 - RNA, 18 nt, artificial
  Chemically synthesized
ccauggcugggaucagag

SEQ ID NO: 11887 - RNA, 18 nt, artificial
  Chemically synthesized
cucaucucaaacagccau

SEQ ID NO: 11888 - RNA, 18 nt, artificial
  Chemically synthesized
auuucacaccuccacgca

SEQ ID NO: 11889 - RNA, 18 nt, artificial
  Chemically synthesized
gggcauuugauguagaac

SEQ ID NO: 11890 - RNA, 18 nt, artificial
  Chemically synthesized
ggcuaaacucuggauggg

SEQ ID NO: 11891 - RNA, 18 nt, artificial
  Chemically synthesized
uaacaaaggcaucauaga

SEQ ID NO: 11892 - RNA, 18 nt, artificial
  Chemically synthesized
aagugacagaguguacuu

SEQ ID NO: 11893 - RNA, 18 nt, artificial
  Chemically synthesized
caccugguuggauaaagu

SEQ ID NO: 11894 - RNA, 18 nt, artificial
  Chemically synthesized
agcuuaugaagccuaauu

SEQ ID NO: 11895 - RNA, 18 nt, artificial
  Chemically synthesized
gagggaucccagccaucu

SEQ ID NO: 11896 - RNA, 18 nt, artificial
  Chemically synthesized
cacuguuccuucuggauu

SEQ ID NO: 11897 - RNA, 18 nt, artificial
  Chemically synthesized
uuucacuaguacaugaga

SEQ ID NO: 11898 - RNA, 18 nt, artificial
  Chemically synthesized
aauugccagccauuuuca

SEQ ID NO: 11899 - RNA, 18 nt, artificial
  Chemically synthesized
accuccacgcagggcucc

SEQ ID NO: 11900 - RNA, 18 nt, artificial
  Chemically synthesized
agcaucaggugaaaauag

SEQ ID NO: 11901 - RNA, 18 nt, artificial
  Chemically synthesized
uguggcagcauuuaauac

SEQ ID NO: 11902 - RNA, 18 nt, artificial
  Chemically synthesized
cuuggaaaaugcuguagu

SEQ ID NO: 11903 - RNA, 18 nt, artificial
  Chemically synthesized
gguagagagguggcuuag

SEQ ID NO: 11904 - RNA, 18 nt, artificial
  Chemically synthesized
uucacaaguacaagcaaa

SEQ ID NO: 11905 - RNA, 18 nt, artificial
  Chemically synthesized
gauaugugcacaaaugca

SEQ ID NO: 11906 - RNA, 18 nt, artificial
  Chemically synthesized
uuuaggcugguuguccca

SEQ ID NO: 11907 - RNA, 18 nt, artificial
  Chemically synthesized
gcccugauagggauacau

SEQ ID NO: 11908 - RNA, 18 nt, artificial
  Chemically synthesized
aggaaacagcaauguaua

SEQ ID NO: 11909 - RNA, 18 nt, artificial
  Chemically synthesized
cagcugggcaagaaaugc

SEQ ID NO: 11910 - RNA, 18 nt, artificial
  Chemically synthesized
guaguucuccuggcagug

SEQ ID NO: 11911 - RNA, 18 nt, artificial
  Chemically synthesized
agaaugaccaggaugguu

SEQ ID NO: 11912 - RNA, 18 nt, artificial
  Chemically synthesized
guccaagugcucuagauu

SEQ ID NO: 11913 - RNA, 18 nt, artificial
  Chemically synthesized
ucuuucuguuuucucugu

SEQ ID NO: 11914 - RNA, 18 nt, artificial
  Chemically synthesized
gggauaugugcacaaaug

SEQ ID NO: 11915 - RNA, 18 nt, artificial
  Chemically synthesized
cccuagaccugcucaaac

SEQ ID NO: 11916 - RNA, 18 nt, artificial
  Chemically synthesized
auucaaaagacucaggaa

SEQ ID NO: 11917 - RNA, 18 nt, artificial
  Chemically synthesized
cagcccugauagggauac

SEQ ID NO: 11918 - RNA, 18 nt, artificial
  Chemically synthesized
uaacaccauugaagcuca

SEQ ID NO: 11919 - RNA, 18 nt, artificial
  Chemically synthesized
aaacgccugcagaccagu

SEQ ID NO: 11920 - RNA, 18 nt, artificial
  Chemically synthesized
auuuaccauccagcaggg

SEQ ID NO: 11921 - RNA, 18 nt, artificial
  Chemically synthesized
agacuggagagugaguua

SEQ ID NO: 11922 - RNA, 18 nt, artificial
  Chemically synthesized
agucagcuuaugaagccu

SEQ ID NO: 11923 - RNA, 18 nt, artificial
  Chemically synthesized
cucuggugugaguaugag

SEQ ID NO: 11924 - RNA, 18 nt, artificial
  Chemically synthesized
cucauccuggcuugagua

SEQ ID NO: 11925 - RNA, 18 nt, artificial
  Chemically synthesized
acagccauagacauccau

SEQ ID NO: 11926 - RNA, 18 nt, artificial
  Chemically synthesized
ccuccacgcagggcuccc

SEQ ID NO: 11927 - RNA, 18 nt, artificial
  Chemically synthesized
augugggaaacuguccaa

SEQ ID NO: 11928 - RNA, 18 nt, artificial
  Chemically synthesized
agggaucccagccaucug

SEQ ID NO: 11929 - RNA, 18 nt, artificial
  Chemically synthesized
gggcuuuucugagucguc

SEQ ID NO: 11930 - RNA, 18 nt, artificial
  Chemically synthesized
agguaguagucuaaguau

SEQ ID NO: 11931 - RNA, 18 nt, artificial
  Chemically synthesized
uuuaucagcccauauguu

SEQ ID NO: 11932 - RNA, 18 nt, artificial
  Chemically synthesized
cuugagauuagcagcccu

SEQ ID NO: 11933 - RNA, 18 nt, artificial
  Chemically synthesized
gcugaaauggaggcaccc

SEQ ID NO: 11934 - RNA, 18 nt, artificial
  Chemically synthesized
cagaccuugaauacaagu

SEQ ID NO: 11935 - RNA, 18 nt, artificial
  Chemically synthesized
acacacacuuucaaauac

SEQ ID NO: 11936 - RNA, 18 nt, artificial
  Chemically synthesized
ccacauuaaguucuuuca

SEQ ID NO: 11937 - RNA, 18 nt, artificial
  Chemically synthesized
gcggaaauuuucuucccg

SEQ ID NO: 11938 - RNA, 18 nt, artificial
  Chemically synthesized
auugcccaacaggaaaca

SEQ ID NO: 11939 - RNA, 18 nt, artificial
  Chemically synthesized
ugaaugcguggcucgcua

SEQ ID NO: 11940 - RNA, 18 nt, artificial
  Chemically synthesized
gucaaaacuaccaaaaug

SEQ ID NO: 11941 - RNA, 18 nt, artificial
  Chemically synthesized
guguuccugcugagaagg

SEQ ID NO: 11942 - RNA, 18 nt, artificial
  Chemically synthesized
ccuaaagagauucagagg

SEQ ID NO: 11943 - RNA, 18 nt, artificial
  Chemically synthesized
gcccugugaaugcguggc

SEQ ID NO: 11944 - RNA, 18 nt, artificial
  Chemically synthesized
agccagaccuugaauaca

SEQ ID NO: 11945 - RNA, 18 nt, artificial
  Chemically synthesized
cauucguucaacuuccac

SEQ ID NO: 11946 - RNA, 18 nt, artificial
  Chemically synthesized
ugccugagcagggucuuc

SEQ ID NO: 11947 - RNA, 18 nt, artificial
  Chemically synthesized
gaagacucuguauuuuag

SEQ ID NO: 11948 - RNA, 18 nt, artificial
  Chemically synthesized
caagagcugccucugguc

SEQ ID NO: 11949 - RNA, 18 nt, artificial
  Chemically synthesized
agaauugccagccauuuu

SEQ ID NO: 11950 - RNA, 18 nt, artificial
  Chemically synthesized
uuguucuaagcccaagaa

SEQ ID NO: 11951 - RNA, 18 nt, artificial
  Chemically synthesized
cacacacuuucaaauaca

SEQ ID NO: 11952 - RNA, 18 nt, artificial
  Chemically synthesized
cuuuggaaugacaucgag

SEQ ID NO: 11953 - RNA, 18 nt, artificial
  Chemically synthesized
caccauugaagcucagau

SEQ ID NO: 11954 - RNA, 18 nt, artificial
  Chemically synthesized
gagacuggacaagccauu

SEQ ID NO: 11955 - RNA, 18 nt, artificial
  Chemically synthesized
uccauuucaaauggaugu

SEQ ID NO: 11956 - RNA, 18 nt, artificial
  Chemically synthesized
aacucauuucaugagguc

SEQ ID NO: 11957 - RNA, 18 nt, artificial
  Chemically synthesized
caacucauuucaugaggu

SEQ ID NO: 11958 - RNA, 18 nt, artificial
  Chemically synthesized
cguggcucgcuaucaccg

SEQ ID NO: 11959 - RNA, 18 nt, artificial
  Chemically synthesized
gacacuuauaaggaaacg

SEQ ID NO: 11960 - RNA, 18 nt, artificial
  Chemically synthesized
caggaaacucugguguuc

SEQ ID NO: 11961 - RNA, 18 nt, artificial
  Chemically synthesized
ucaagguaaaugagguuu

SEQ ID NO: 11962 - RNA, 18 nt, artificial
  Chemically synthesized
auugcacaggcccucuag

SEQ ID NO: 11963 - RNA, 18 nt, artificial
  Chemically synthesized
uuagacaacucccuauuu

SEQ ID NO: 11964 - RNA, 18 nt, artificial
  Chemically synthesized
ggagcauugcccaacagg

SEQ ID NO: 11965 - RNA, 18 nt, artificial
  Chemically synthesized
ugugcacaaaugcacaca

SEQ ID NO: 11966 - RNA, 18 nt, artificial
  Chemically synthesized
aguguacuuuuccauacu

SEQ ID NO: 11967 - RNA, 18 nt, artificial
  Chemically synthesized
gacaacucccuauuuccu

SEQ ID NO: 11968 - RNA, 18 nt, artificial
  Chemically synthesized
ccaagaaguuugaacuca

SEQ ID NO: 11969 - RNA, 18 nt, artificial
  Chemically synthesized
aaauacacacagcccuga

SEQ ID NO: 11970 - RNA, 18 nt, artificial
  Chemically synthesized
cuccagguaaguguuccu

SEQ ID NO: 11971 - RNA, 18 nt, artificial
  Chemically synthesized
ccucuaccauacuuuaug

SEQ ID NO: 11972 - RNA, 18 nt, artificial
  Chemically synthesized
gaaaagaacaaugucucu

SEQ ID NO: 11973 - RNA, 18 nt, artificial
  Chemically synthesized
cuuucuuugucauggguu

SEQ ID NO: 11974 - RNA, 18 nt, artificial
  Chemically synthesized
gacacauuguuuucucaa

SEQ ID NO: 11975 - RNA, 18 nt, artificial
  Chemically synthesized
cucagguaauuugaaaga

SEQ ID NO: 11976 - RNA, 18 nt, artificial
  Chemically synthesized
guagauaacaaaggcauc

SEQ ID NO: 11977 - RNA, 18 nt, artificial
  Chemically synthesized
guucaacuuccaccaaga

SEQ ID NO: 11978 - RNA, 18 nt, artificial
  Chemically synthesized
uagauguuuucaccucua

SEQ ID NO: 11979 - RNA, 18 nt, artificial
  Chemically synthesized
gugcaccauggaauuacu

SEQ ID NO: 11980 - RNA, 18 nt, artificial
  Chemically synthesized
cuguacccacuguuccuu

SEQ ID NO: 11981 - RNA, 18 nt, artificial
  Chemically synthesized
auaggguucagggacagg

SEQ ID NO: 11982 - RNA, 18 nt, artificial
  Chemically synthesized
ccaacaggaaacagcaau

SEQ ID NO: 11983 - RNA, 18 nt, artificial
  Chemically synthesized
gcaaagucauucugagua

SEQ ID NO: 11984 - RNA, 18 nt, artificial
  Chemically synthesized
ccauauguuucuggaauc

SEQ ID NO: 11985 - RNA, 18 nt, artificial
  Chemically synthesized
gcccugcauaucuagugc

SEQ ID NO: 11986 - RNA, 18 nt, artificial
  Chemically synthesized
cacuggaagcuccuugag

SEQ ID NO: 11987 - RNA, 18 nt, artificial
  Chemically synthesized
cugaggucaucccacuuc

SEQ ID NO: 11988 - RNA, 18 nt, artificial
  Chemically synthesized
uuuaccauccagcagggc

SEQ ID NO: 11989 - RNA, 18 nt, artificial
  Chemically synthesized
aaagcaacucugguguga

SEQ ID NO: 11990 - RNA, 18 nt, artificial
  Chemically synthesized
auguucaaucacccuaga

SEQ ID NO: 11991 - RNA, 18 nt, artificial
  Chemically synthesized
ucaagccauuucuacuga

SEQ ID NO: 11992 - RNA, 18 nt, artificial
  Chemically synthesized
guaaguguuccugcugag

SEQ ID NO: 11993 - RNA, 18 nt, artificial
  Chemically synthesized
agcccauauguuucugga

SEQ ID NO: 11994 - RNA, 18 nt, artificial
  Chemically synthesized
ccagaccuugaauacaag

SEQ ID NO: 11995 - RNA, 18 nt, artificial
  Chemically synthesized
ucauccuggcuugaguag

SEQ ID NO: 11996 - RNA, 18 nt, artificial
  Chemically synthesized
cagcaauugguguauuca

SEQ ID NO: 11997 - RNA, 18 nt, artificial
  Chemically synthesized
gcaucauagauguuuuca

SEQ ID NO: 11998 - RNA, 18 nt, artificial
  Chemically synthesized
gaaaaggcucccagggcu

SEQ ID NO: 11999 - RNA, 18 nt, artificial
  Chemically synthesized
ucagagucccagccaggc

SEQ ID NO: 12000 - RNA, 18 nt, artificial
  Chemically synthesized
acucaggaaaagaacaau

SEQ ID NO: 12001 - RNA, 18 nt, artificial
  Chemically synthesized
ccaccuuuguuggaagug

SEQ ID NO: 12002 - RNA, 18 nt, artificial
  Chemically synthesized
acauucuuuucugggaac

SEQ ID NO: 12003 - RNA, 18 nt, artificial
  Chemically synthesized
agauacuacaagcacacu

SEQ ID NO: 12004 - RNA, 18 nt, artificial
  Chemically synthesized
acucauuucaugagguca

SEQ ID NO: 12005 - RNA, 18 nt, artificial
  Chemically synthesized
ucaccuuucggcuuuuau

SEQ ID NO: 12006 - RNA, 18 nt, artificial
  Chemically synthesized
guugucccaaaaucacuu

SEQ ID NO: 12007 - RNA, 18 nt, artificial
  Chemically synthesized
acaucuacuuucacuagu

SEQ ID NO: 12008 - RNA, 18 nt, artificial
  Chemically synthesized
caaaaucacuuugagaac

SEQ ID NO: 12009 - RNA, 18 nt, artificial
  Chemically synthesized
gcggcaaccuuagcauuc

SEQ ID NO: 12010 - RNA, 18 nt, artificial
  Chemically synthesized
caaaauguggucaaggag

SEQ ID NO: 12011 - RNA, 18 nt, artificial
  Chemically synthesized
aacaaguguuggacccag

SEQ ID NO: 12012 - RNA, 18 nt, artificial
  Chemically synthesized
gcuuucuggucucacgca

SEQ ID NO: 12013 - RNA, 18 nt, artificial
  Chemically synthesized
gugaaagcggcaaccuua

SEQ ID NO: 12014 - RNA, 18 nt, artificial
  Chemically synthesized
guucagucaaaacuacca

SEQ ID NO: 12015 - RNA, 18 nt, artificial
  Chemically synthesized
acaaagugacagagugua

SEQ ID NO: 12016 - RNA, 18 nt, artificial
  Chemically synthesized
acguauccaaugaaaaga

SEQ ID NO: 12017 - RNA, 18 nt, artificial
  Chemically synthesized
aacuuuuccaaguuuccu

SEQ ID NO: 12018 - RNA, 18 nt, artificial
  Chemically synthesized
ugggaaacuguccaaauu

SEQ ID NO: 12019 - RNA, 18 nt, artificial
  Chemically synthesized
guguuggacccagcuggg

SEQ ID NO: 12020 - RNA, 18 nt, artificial
  Chemically synthesized
ucccagccaggcgcgagg

SEQ ID NO: 12021 - RNA, 18 nt, artificial
  Chemically synthesized
aaaacgccugcagaccag

SEQ ID NO: 12022 - RNA, 18 nt, artificial
  Chemically synthesized
cacacuuucaaauacaca

SEQ ID NO: 12023 - RNA, 18 nt, artificial
  Chemically synthesized
acagaguguacuuuucca

SEQ ID NO: 12024 - RNA, 18 nt, artificial
  Chemically synthesized
uuacccaguccucauccu

SEQ ID NO: 12025 - RNA, 18 nt, artificial
  Chemically synthesized
ucagcccauauguuucug

SEQ ID NO: 12026 - RNA, 18 nt, artificial
  Chemically synthesized
ucaaauugcacaggcccu

SEQ ID NO: 12027 - RNA, 18 nt, artificial
  Chemically synthesized
caccuccacgcagggcuc

SEQ ID NO: 12028 - RNA, 18 nt, artificial
  Chemically synthesized
cagggucuucuccaccuu

SEQ ID NO: 12029 - RNA, 18 nt, artificial
  Chemically synthesized
ugggaaccuucuuuauaa

SEQ ID NO: 12030 - RNA, 18 nt, artificial
  Chemically synthesized
uagaccugcucaaaccaa

SEQ ID NO: 12031 - RNA, 18 nt, artificial
  Chemically synthesized
gcuucuguaaacuugaua

SEQ ID NO: 12032 - RNA, 18 nt, Artificial Sequence
  Chemically synthesized
uuagcauaaggccugaca

SEQ ID NO: 12033 - RNA, 18 nt, artificial
  Chemically synthesized
cagcaggaacacuuaccu

SEQ ID NO: 12034 - RNA, 18 nt, artificial
  Chemically synthesized
uaucuacucaagccagga

SEQ ID NO: 12035 - RNA, 18 nt, artificial
  Chemically synthesized
aaauggcuggcaauucuu

SEQ ID NO: 12036 - RNA, 18 nt, artificial
  Chemically synthesized
uuaccaugaguucaaacu

SEQ ID NO: 12037 - RNA, 18 nt, artificial
  Chemically synthesized
ucaaacuucuugggcuua

SEQ ID NO: 12038 - RNA, 18 nt, artificial
  Chemically synthesized
agcaggaacacuuaccug

SEQ ID NO: 12039 - RNA, 18 nt, artificial
  Chemically synthesized
aauggcuggcaauucuuu

SEQ ID NO: 12040 - RNA, 18 nt, artificial
  Chemically synthesized
auggcuggcaauucuuuc

SEQ ID NO: 12041 - RNA, 18 nt, artificial
  Chemically synthesized
ucagcucugccuucacua

SEQ ID NO: 12042 - RNA, 18 nt, artificial
  Chemically synthesized
auuaccaugaguucaaac

SEQ ID NO: 12043 - RNA, 18 nt, artificial
  Chemically synthesized
auuguccugcagaaggug

SEQ ID NO: 12044 - RNA, 18 nt, artificial
  Chemically synthesized
uacagcauuuuccaagua

SEQ ID NO: 12045 - RNA, 18 nt, artificial
  Chemically synthesized
gugucccagcacuucauc

SEQ ID NO: 12046 - RNA, 18 nt, artificial
  Chemically synthesized
cuggcugggacucugauc

SEQ ID NO: 12047 - RNA, 18 nt, artificial
  Chemically synthesized
ucaaucucucuuuagacc

SEQ ID NO: 12048 - RNA, 18 nt, artificial
  Chemically synthesized
aacuuuauccaaccaggu

SEQ ID NO: 12049 - RNA, 18 nt, artificial
  Chemically synthesized
auugcucagaccuggcag

SEQ ID NO: 12050 - RNA, 18 nt, artificial
  Chemically synthesized
uuuguuaucuacucaagc

SEQ ID NO: 12051 - RNA, 18 nt, artificial
  Chemically synthesized
gaguucaaacuucuuggg

SEQ ID NO: 12052 - RNA, 18 nt, artificial
  Chemically synthesized
uuuagaucugagcuucaa

SEQ ID NO: 12053 - RNA, 18 nt, artificial
  Chemically synthesized
uaucaucuucauuguccu

SEQ ID NO: 12054 - RNA, 18 nt, artificial
  Chemically synthesized
ucucagcaggaacacuua

SEQ ID NO: 12055 - RNA, 18 nt, artificial
  Chemically synthesized
uauuuucaccugaugcuu

SEQ ID NO: 12056 - RNA, 18 nt, artificial
  Chemically synthesized
auuucagcucugccuuca

SEQ ID NO: 12057 - RNA, 18 nt, artificial
  Chemically synthesized
ucuauuuucaccugaugc

SEQ ID NO: 12058 - RNA, 18 nt, artificial
  Chemically synthesized
aaucucucuuuagaccug

SEQ ID NO: 12059 - RNA, 18 nt, artificial
  Chemically synthesized
uuaauguggcucacaauc

SEQ ID NO: 12060 - RNA, 18 nt, artificial
  Chemically synthesized
auuuucaccugaugcuuc

SEQ ID NO: 12061 - RNA, 18 nt, artificial
  Chemically synthesized
cagcacuucauccagagc

SEQ ID NO: 12062 - RNA, 18 nt, artificial
  Chemically synthesized
uuagaucugagcuucaau

SEQ ID NO: 12063 - RNA, 18 nt, artificial
  Chemically synthesized
gccaggaugaggacuggg

SEQ ID NO: 12064 - RNA, 18 nt, artificial
  Chemically synthesized
aagccaggaugaggacug

SEQ ID NO: 12065 - RNA, 18 nt, artificial
  Chemically synthesized
uucuauuuucaccugaug

SEQ ID NO: 12066 - RNA, 18 nt, artificial
  Chemically synthesized
uucauuguccugcagaag

SEQ ID NO: 12067 - RNA, 18 nt, artificial
  Chemically synthesized
auugcugccaacaucauc

SEQ ID NO: 12068 - RNA, 18 nt, artificial
  Chemically synthesized
uaugagauugcucagacc

SEQ ID NO: 12069 - RNA, 18 nt, artificial
  Chemically synthesized
ucauccagagccgcuggu

SEQ ID NO: 12070 - RNA, 18 nt, artificial
  Chemically synthesized
cgcgccuggcugggacuc

SEQ ID NO: 12071 - RNA, 18 nt, artificial
  Chemically synthesized
ugcugccaacaucaucca

SEQ ID NO: 12072 - RNA, 18 nt, artificial
  Chemically synthesized
agccaggaugaggacugg

SEQ ID NO: 12073 - RNA, 18 nt, artificial
  Chemically synthesized
aauauugacaggaaaccc

SEQ ID NO: 12074 - RNA, 18 nt, artificial
  Chemically synthesized
uugcucagaccuggcagu

SEQ ID NO: 12075 - RNA, 18 nt, artificial
  Chemically synthesized
uagaucugagcuucaaug

SEQ ID NO: 12076 - RNA, 18 nt, artificial
  Chemically synthesized
uuuucaccugaugcuucu

SEQ ID NO: 12077 - RNA, 18 nt, artificial
  Chemically synthesized
cccagccauggccuuccu

SEQ ID NO: 12078 - RNA, 18 nt, artificial
  Chemically synthesized
ucagcaggaacacuuacc

SEQ ID NO: 12079 - RNA, 18 nt, artificial
  Chemically synthesized
uaugaugccuuuguuauc

SEQ ID NO: 12080 - RNA, 18 nt, artificial
  Chemically synthesized
aucccagccauggccuuc

SEQ ID NO: 12081 - RNA, 18 nt, artificial
  Chemically synthesized
uuucagcucugccuucac

SEQ ID NO: 12082 - RNA, 18 nt, artificial
  Chemically synthesized
ucaagccaggaugaggac

SEQ ID NO: 12083 - RNA, 18 nt, artificial
  Chemically synthesized
ucccagccauggccuucc

SEQ ID NO: 12084 - RNA, 18 nt, artificial
  Chemically synthesized
uucauccagagccgcugg

SEQ ID NO: 12085 - RNA, 18 nt, artificial
  Chemically synthesized
agguaaguguuccugcug

SEQ ID NO: 12086 - RNA, 18 nt, artificial
  Chemically synthesized
uccuggcuugaguagaua

SEQ ID NO: 12087 - RNA, 18 nt, artificial
  Chemically synthesized
aagaauugccagccauuu

SEQ ID NO: 12088 - RNA, 18 nt, artificial
  Chemically synthesized
aguuugaacucaugguaa

SEQ ID NO: 12089 - RNA, 18 nt, artificial
  Chemically synthesized
uaagcccaagaaguuuga

SEQ ID NO: 12090 - RNA, 18 nt, artificial
  Chemically synthesized
cagguaaguguuccugcu

SEQ ID NO: 12091 - RNA, 18 nt, artificial
  Chemically synthesized
aaagaauugccagccauu

SEQ ID NO: 12092 - RNA, 18 nt, artificial
  Chemically synthesized
gaaagaauugccagccau

SEQ ID NO: 12093 - RNA, 18 nt, artificial
  Chemically synthesized
uagugaaggcagagcuga

SEQ ID NO: 12094 - RNA, 18 nt, artificial
  Chemically synthesized
guuugaacucaugguaau

SEQ ID NO: 12095 - RNA, 18 nt, artificial
  Chemically synthesized
caccuucugcaggacaau

SEQ ID NO: 12096 - RNA, 18 nt, artificial
  Chemically synthesized
uacuuggaaaaugcugua

SEQ ID NO: 12097 - RNA, 18 nt, artificial
  Chemically synthesized
gaugaagugcugggacac

SEQ ID NO: 12098 - RNA, 18 nt, artificial
  Chemically synthesized
gaucagagucccagccag

SEQ ID NO: 12099 - RNA, 18 nt, artificial
  Chemically synthesized
ggucuaaagagagauuga

SEQ ID NO: 12100 - RNA, 18 nt, artificial
  Chemically synthesized
accugguuggauaaaguu

SEQ ID NO: 12101 - RNA, 18 nt, artificial
  Chemically synthesized
cugccaggucugagcaau

SEQ ID NO: 12102 - RNA, 18 nt, artificial
  Chemically synthesized
gcuugaguagauaacaaa

SEQ ID NO: 12103 - RNA, 18 nt, artificial
  Chemically synthesized
cccaagaaguuugaacuc

SEQ ID NO: 12104 - RNA, 18 nt, artificial
  Chemically synthesized
uugaagcucagaucuaaa

SEQ ID NO: 12105 - RNA, 18 nt, artificial
  Chemically synthesized
aggacaaugaagaugaua

SEQ ID NO: 12106 - RNA, 18 nt, artificial
  Chemically synthesized
uaaguguuccugcugaga

SEQ ID NO: 12107 - RNA, 18 nt, artificial
  Chemically synthesized
aagcaucaggugaaaaua

SEQ ID NO: 12108 - RNA, 18 nt, artificial
  Chemically synthesized
ugaaggcagagcugaaau

SEQ ID NO: 12109 - RNA, 18 nt, artificial
  Chemically synthesized
gcaucaggugaaaauaga

SEQ ID NO: 12110 - RNA, 18 nt, artificial
  Chemically synthesized
caggucuaaagagagauu

SEQ ID NO: 12111 - RNA, 18 nt, artificial
  Chemically synthesized
gauugugagccacauuaa

SEQ ID NO: 12112 - RNA, 18 nt, artificial
  Chemically synthesized
gaagcaucaggugaaaau

SEQ ID NO: 12113 - RNA, 18 nt, artificial
  Chemically synthesized
gcucuggaugaagugcug

SEQ ID NO: 12114 - RNA, 18 nt, artificial
  Chemically synthesized
auugaagcucagaucuaa

SEQ ID NO: 12115 - RNA, 18 nt, artificial
  Chemically synthesized
cccaguccucauccuggc

SEQ ID NO: 12116 - RNA, 18 nt, artificial
  Chemically synthesized
caguccucauccuggcuu

SEQ ID NO: 12117 - RNA, 18 nt, artificial
  Chemically synthesized
caucaggugaaaauagaa

SEQ ID NO: 12118 - RNA, 18 nt, artificial
  Chemically synthesized
cuucugcaggacaaugaa

SEQ ID NO: 12119 - RNA, 18 nt, artificial
  Chemically synthesized
gaugauguuggcagcaau

SEQ ID NO: 12120 - RNA, 18 nt, artificial
  Chemically synthesized
ggucugagcaaucucaua

SEQ ID NO: 12121 - RNA, 18 nt, artificial
  Chemically synthesized
accagcggcucuggauga

SEQ ID NO: 12122 - RNA, 18 nt, artificial
  Chemically synthesized
gagucccagccaggcgcg

SEQ ID NO: 12123 - RNA, 18 nt, artificial
  Chemically synthesized
uggaugauguuggcagca

SEQ ID NO: 12124 - RNA, 18 nt, artificial
  Chemically synthesized
ccaguccucauccuggcu

SEQ ID NO: 12125 - RNA, 18 nt, artificial
  Chemically synthesized
ggguuuccugucaauauu

SEQ ID NO: 12126 - RNA, 18 nt, artificial
  Chemically synthesized
acugccaggucugagcaa

SEQ ID NO: 12127 - RNA, 18 nt, artificial
  Chemically synthesized
cauugaagcucagaucua

SEQ ID NO: 12128 - RNA, 18 nt, artificial
  Chemically synthesized
agaagcaucaggugaaaa

SEQ ID NO: 12129 - RNA, 18 nt, artificial
  Chemically synthesized
aggaaggccauggcuggg

SEQ ID NO: 12130 - RNA, 18 nt, artificial
  Chemically synthesized
gguaaguguuccugcuga

SEQ ID NO: 12131 - RNA, 18 nt, artificial
  Chemically synthesized
gauaacaaaggcaucaua

SEQ ID NO: 12132 - RNA, 18 nt, artificial
  Chemically synthesized
gaaggccauggcugggau

SEQ ID NO: 12133 - RNA, 18 nt, artificial
  Chemically synthesized
gugaaggcagagcugaaa

SEQ ID NO: 12134 - RNA, 18 nt, artificial
  Chemically synthesized
guccucauccuggcuuga

SEQ ID NO: 12135 - RNA, 18 nt, artificial
  Chemically synthesized
ggaaggccauggcuggga

SEQ ID NO: 12136 - RNA, 18 nt, Artificial Sequence
  Chemically synthesized
ccagcggcucuggaugaa

That which is claimed is:

1. A method for treating a lung disorder, lung disease or lung injury in a subject in need thereof comprising administering to the subject a therapeutically-effective combination of at least one TLR2 inhibitor or a pharmaceutically acceptable salt thereof, wherein the TLR2 inhibitor comprises a nucleic acid molecule targeting a TLR2 gene; and at least one TLR4 inhibitor or a pharmaceutically acceptable salt, wherein the TLR4 inhibitor comprises a nucleic acid molecule targeting a TLR4 gene, thereby treating the lung disorder, lung disease or lung injury in the subject, wherein the lung disorder, lung disease or lung injury is a disorder associated with lung transplantation.

2. The method of claim 1, wherein the lung disorder associated with lung transplantation is selected from the group consisting of inflammation, graft rejection, primary graft failure, ischemia-reperfusion injury, reperfusion injury, reperfusion edema, allograft dysfunction, acute graft dysfunction, pulmonary reimplantation response, bronchiolitis obliterans and primary graft dysfunction (PGD).

3. The method of claim 2, wherein the lung disorder associated with lung transplantation is PGD.

4. The method of claim 1, wherein the TLR2 inhibitor is a double stranded oligonucleotide comprising:
   (a) a sense strand and an antisense strand;
   (b) each strand is independently 17 to 40 nucleotides in length;
   (c) a 17 to 40 nucleotide sequence of the antisense strand is complementary to a sequence of an mRNA encoding TLR2; and
   (d) a 17 to 40 nucleotide sequence of the sense strand is complementary to the antisense strand; and wherein the TLR4 inhibitor is a double stranded oligonucleotide comprising:
   (a) a sense strand and an antisense strand;
   (b) each strand is independently 17 to 40 nucleotides in length;
   (c) a 17 to 40 nucleotide sequence of the antisense strand is complementary to a sequence of an mRNA encoding TLR4; and
   (d) a 17 to 40 nucleotide sequence of the sense strand is complementary to the antisense strand.

5. The method of claim 4, wherein the sequence of mRNA encoding TLR2 is set forth in SEQ ID NO:1 and wherein the sequence of mRNA encoding TLR4 is set forth in any one of SEQ ID NO:2, SEQ ID NO:3 and SEQ ID NO:4.

6. The method of claim 1, wherein the nucleic acid molecule targeting the TLR2 gene and the nucleic acid molecule targeting the TLR4 gene are independently selected from the group consisting of a short interfering nucleic acid (siNA), short interfering RNA (siRNA), double-stranded RNA (dsRNA), micro-RNA (miRNA) or short hairpin RNA (shRNA).

* * * * *